United States Patent
Beattie et al.

(10) Patent No.: US 10,975,387 B2
(45) Date of Patent: Apr. 13, 2021

(54) COMPOSITIONS AND METHODS FOR CONTROLLING INSECT PESTS

(71) Applicant: MONSANTO TECHNOLOGY LLC, St. Louis, MO (US)

(72) Inventors: Jodi Beattie, Wentzville, MO (US); Michael John Crawford, St. Louis, MO (US); Brian Donovan Eads, Kirkwood, MO (US)

(73) Assignee: MONSANTO TECHNOLOGY LLC, St. Louis, MO (US)

( * ) Notice: Subject to any disclaimer, the term of this patent is extended or adjusted under 35 U.S.C. 154(b) by 0 days.

(21) Appl. No.: 16/072,824

(22) PCT Filed: Jan. 26, 2017

(86) PCT No.: PCT/US2017/015061
§ 371 (c)(1),
(2) Date: Jul. 25, 2018

(87) PCT Pub. No.: WO2017/132330
PCT Pub. Date: Aug. 3, 2017

(65) Prior Publication Data
US 2019/0032076 A1 Jan. 31, 2019

Related U.S. Application Data

(60) Provisional application No. 62/287,080, filed on Jan. 26, 2016.

(51) Int. Cl.
*C12N 15/82* (2006.01)
*C07K 14/195* (2006.01)

(52) U.S. Cl.
CPC ........ *C12N 15/8286* (2013.01); *C07K 14/195* (2013.01); *C12N 15/8218* (2013.01); *Y02A 40/146* (2018.01)

(58) Field of Classification Search
CPC ................................................ C12N 15/8286
USPC ........................................................ 800/302
See application file for complete search history.

(56) References Cited

U.S. PATENT DOCUMENTS

| | | |
|---|---|---|
| 2006/0272049 A1 | 11/2006 | Waterhouse et al. |
| 2007/0050860 A1 | 3/2007 | Andersen et al. |
| 2009/0118214 A1 | 5/2009 | Paldi et al. |
| 2012/0053231 A1 | 3/2012 | Sela et al. |
| 2012/0108497 A1 | 5/2012 | Paldi et al. |
| 2012/0164205 A1* | 6/2012 | Baum .................... A01N 63/02 424/409 |
| 2012/0258646 A1 | 10/2012 | Sela et al. |
| 2013/0058890 A1 | 3/2013 | Raemaekers et al. |
| 2013/0289097 A1 | 10/2013 | Paldi et al. |
| 2013/0291188 A1 | 10/2013 | Bogaert et al. |
| 2014/0275208 A1* | 9/2014 | Hu ....................... C12N 15/113 514/44 A |
| 2014/0371298 A1 | 12/2014 | Sela et al. |
| 2015/0133532 A1 | 5/2015 | Sela et al. |
| 2015/0159156 A1 | 6/2015 | Inberg et al. |
| 2017/0037407 A1 | 2/2017 | Gleit-Kielmanowicz et al. |
| 2017/0088838 A1 | 3/2017 | Inberg et al. |
| 2017/0183683 A1 | 6/2017 | Baum et al. |
| 2017/0233743 A1 | 8/2017 | Sela et al. |
| 2017/0260522 A1 | 9/2017 | Crawford et al. |
| 2018/0148737 A1 | 5/2018 | Bogaert et al. |
| 2018/0371459 A1 | 12/2018 | Inberg et al. |
| 2019/0203206 A1 | 7/2019 | Inberg et al. |
| 2019/0316130 A1 | 10/2019 | Crawford et al. |

FOREIGN PATENT DOCUMENTS

| | | |
|---|---|---|
| CN | 103201385 A | 7/2013 |
| WO | WO 2016/018887 A1 | 2/2016 |

OTHER PUBLICATIONS

Thomas et al. (2001, The Plant Journal 25(4):417-425.*
Bachman et al., "Characterization of the spectrum of insecticidal activity of a double-stranded RNA with targeted activity against Western Corn Rootworm (*Diabrotica virgifera virgifera* LeConte)", *Transgenic Res.*, 22:1207-1222 (2013).
Bhatia et al., "Aphid resistance in *Brassica* crops: Challenges, biotechnological progress and emerging possibilities," *Biotechnology Advances* 29:879-955 (2011).
Extended European Search Report dated May 23, 2019, in European Patent Application No. 15826865.6
Extended European Search Report dated Sep. 5, 2019, in European Patent Application No. 17744874.3
Final Office Action dated Dec. 11, 2018, U.S. Appl. No. 15/329,808.
First Office Action dated Sep. 20, 2019, in Chinese Patent Application No. 201580041557.2 (with English language translation).
Huvenne et al., "Mechanisms of dsRNA uptake in insects and potential of RNAi for pest control: A review," *Journal of Insect Physiology*, 56:227-235 (2010).
International Search Report and Written Opinion dated May 23, 2017, in International Application No. PCT/US2017/015061.
Kondylis et al., "The Golgi apparatus: Lessons from *Drosophila*," *FEBS Letters* 583:3827-3838 (2009).
Non-Final Office Action dated Jun. 11, 2018, U.S. Appl. No. 15/329,808.
Non-Final Office Action dated Mar. 15, 2018, U.S. Appl. No. 15/329,808.

(Continued)

*Primary Examiner* — Li Zheng
(74) *Attorney, Agent, or Firm* — Arnold & Porter Kaye Scholer LLP; Amanda Carmany-Rampey; David R. Marsh

(57) ABSTRACT

Disclosed herein are methods for controlling invertebrate pest infestations, particularly in plants; compositions and insecticidal polynucleotides useful in such methods; and plants having improved resistance to the invertebrate pests. More specifically, insecticidal polynucleotides and methods of use thereof for modifying the expression of genes in an insect pest, particularly through RNA interference are disclosed.

11 Claims, No Drawings
Specification includes a Sequence Listing.

(56) References Cited

OTHER PUBLICATIONS

Office Action dated Dec. 17, 2019, European Patent Application No. European Patent Application No. 15826865.6.
Office Action dated Jan. 11, 2019, European Patent Application No. European Patent Application No. 15826865.6.
Office Action dated May 24, 2019, European Patent Application No. European Patent Application No. 15826865.6.
Partial Supplementary European Search Report dated Jun. 5, 2019, in European Patent Application No. 17744874.3.
Second Office Action dated Jul. 10, 2020, in Chinese Patent Application No. 201580041557.2 (with English language translation).
Thomas et al., "Size constraints for targeting post-transcriptional gene silencing and for RNA-directed methylation in Nicotiana benthamiana using a potato virus X vector," *The Plant Journal*, 25(4):417-425 (2001).
Ulrich et al., "Large scale RNAi screen in Tribolium reveals novel target genes for pest control and the proteasome as prime target," *BMC genomics*, 16(1):671 (2015).
Wang et al., "Silkworm Coatomers and Their Role in Tube Expansion of Posterior Silkgland," *PLoS ONE* 5(10): E133252 (2010).
Yibrah et al., "Antisense RNA inhibition of uidA gene expression in transgenic plants: Evidence for interaction between first and second transformation events," *Hereditas*, 118:273-280 (1993).
Zhao et al., "Phyllotreta striolata (Coleoptera: Chiysomelidae):Arginine kinase cloning and RNAi-based pest control," European Journal of Entomology, 105(5):815-822 (2008).
Zhao et al., "PsOr1, a potential target for RNA interference based pest management," Insect Molecular Biology 20(1):97-104 (2011).

* cited by examiner

COMPOSITIONS AND METHODS FOR CONTROLLING INSECT PESTS

CROSS-REFERENCE TO RELATED APPLICATION AND INCORPORATION OF SEQUENCE LISTING

This application is a U.S. National Stage of International Application No. PCT/US2017/015061, filed Jan. 26, 2017, which claims priority to U.S. Provisional Application No. 62/287,080, filed Jan. 26, 2016, both of which are incorporated by reference in their entirety herein. The sequence listing is contained in the file "P34170US10_SL.TXT", which is 2,289,075 bytes in size (measured in operating system MS Windows) and created on Jul. 25, 2018.

FIELD

Disclosed herein are methods for controlling invertebrate pest infestations, particularly in plants, compositions and insecticidal polynucleotides useful in such methods, and plants having improved resistance to the invertebrate pests. More specifically, insecticidal polynucleotides and methods of use thereof for modifying the expression of genes in an insect pest, particularly through RNA interference are disclosed. Pest species of interest include flea beetles, such as *Phyllotreta* spp. and *Psylliodes* spp.

BACKGROUND

Commercial crops are often the targets of attack by invertebrate pests such as insects. RNA interference (RNAi, RNA-mediated gene suppression) is an approach that shows promise for use in environmentally friendly pest control. In invertebrates, RNAi-based gene suppression was first demonstrated in nematodes (Fire et al., (1998) *Nature*, 391:806-811; Timmons & Fire (1998) *Nature*, 395:854). Subsequently, RNAi-based suppression of invertebrate genes using recombinant nucleic acid techniques has been reported in a number of species, including agriculturally or economically important pests from various insect and nematode taxa, such as: root-knot nematodes (*Meloidogyne* spp.), see Huang et al. (2006) *Proc. Natl. Acad. Sci. USA*, 103:14302-14306, doi:10.1073/pnas.0604698103); cotton bollworm (*Helicoverpa armigera*), see Mao et al. (2007) *Nature Biotechnol.*, 25:1307-1313, doi:10.1038/nbt1352; Western corn rootworm (*Diabrofica virgifera* LeConte), see Baum et al. (2007) *Nature Biotechnol.*, 25:1322-1326, doi:10.1038/nbt1359; sugar beet cyst nematode (*Heterodera schachtii*), see Sindhu et al. (2008) *J. Exp. Botany*, 60:315-324, doi:10.1093/jxb/ern289; mosquito (*Aedes aegypti*), see Pridgeon et al. (2008) *J. Med. Entomol.*, 45:414-420, doi: full/10.1603/0022-2585%282008%2945%5B414%3ATAADRK%5D2.0.CO%3B2; fruit flies (*Drosophila melanogaster*), flour beetles (*Tribolium castaneum*), pea aphids (*Acyrthosiphon pisum*), and tobacco hornworms (*Manduca sexta*), see Whyard et al. (2009) *Insect Biochem. Mol. Biol.*, 39:824-832, doi:10.1016/j.ibmb.2009.09.00; diamondback moth (*Plutella xylostella*), see Gong et al. (2011) *Pest Manag. Sci.*, 67: 514-520, doi:10.1002/ps.2086; green peach aphid (*Myzus persicae*), see Pitino et al. (2011) PLoS ONE, 6:e25709, doi:10.1371/journal.pone.0025709; brown planthopper (*Nilaparvata lugens*), see Li et al. (2011) *Pest Manag. Sci.*, 67:852-859, doi:10.1002/ps.2124; and whitefly (*Bemisia tabaci*), see Upadhyay et al. (2011) *J. Biosci.*, 36:153-161, doi:10.1007/s12038-011-9009-1.

SUMMARY

The present embodiments relate to control of insect species, especially flea beetle species that are economically or agriculturally important pests. The compositions and methods disclosed herein comprise insecticidal polynucleotide molecules that are useful for controlling or preventing infestation by that insect species. Several embodiments described herein relate to a polynucleotide-containing composition (e. g., a composition containing a dsRNA for suppressing a target gene) that is topically applied to an insect species or to a plant, plant part, or seed to be protected from infestation by an insect species. Other embodiments relate to methods for selecting insect target genes that are effective targets for RNAi-mediated control of an insect species.

Several embodiments relate to a method for controlling an insect infestation of a plant comprising contacting the insect with a insecticidal polynucleotide comprising at least one segment of 18 or more contiguous nucleotides with a sequence of about 95% to about 100% complementarity with a fragment of a target gene of the insect. In some embodiments, the insecticidal polynucleotide comprises at least one segment of 21 contiguous nucleotides with a sequence of 100% complementarity with a fragment of a target gene of the insect. In some embodiments, the target gene is selected from the group consisting of Act5C, arginine kinase, COPI (coatomer subunit) alpha, COPI (coatomer subunit) beta, COPI (coatomer subunit) betaPrime, COPI (coatomer subunit) delta, COPI (coatomer subunit) epsilon, COPI (coatomer subunit) gamma, COPI (coatomer subunit) zeta, RpL07, RpL19, RpL3, RpL40, RpS21, RpS4, Rpn2, Rpn3, Rpt6, Rpn8, Rpn9, Rpn6-PB-like protein, Sar1, sec6, sec23, sec23A, shrb (snf7), Tubulin gamma chain, ProsAlpha2, ProsBeta5, Proteasome alpha 2, Proteasome beta 5, VATPase E, VATPase A, VATPase B, VATPase D, Vps2, Vps4, Vps16A, Vps20, Vps24, Vps27, Vps28, Vha26 (V-ATPase A), Vha68-2 (V-ATPase D/E), 40S ribosomal protein S14, and 60S ribosomal protein L13. In some embodiments, the target gene has a DNA sequence selected from the group consisting of SEQ ID NOs:1-859. In some embodiments, the insecticidal polynucleotide comprises a sequence of about 95% to about 100% identity or complementarity with a sequence selected from the group consisting of SEQ ID NOs:860-1718 and 1722-1975 or a fragment thereof. In some embodiments, the insecticidal polynucleotide comprises at least one segment of 21 contiguous nucleotides of a sequence selected from the group consisting of SEQ ID NOs:860-1718 and 1722-1975. In some embodiments, the insecticidal polynucleotide is a dsRNA comprising an RNA strand with a sequence selected from the group consisting of SEQ ID NOs:860-1718 and 1722-1975. In various embodiments, the contacting of the insect is by oral delivery, or by non-oral contact, e. g., by absorption through the cuticle, or through a combination of oral and non-oral delivery. In some embodiments, the insecticidal polynucleotide suppresses a target gene in the insect and stunts growth, development or reproduction by the insect, or kills the insect.

Several embodiments relate to a method of causing mortality or stunting in an insect, comprising providing in the diet of an insect at least one insecticidal polynucleotide comprising at least one silencing element, wherein the at least one silencing element is essentially identical or essentially complementary to a fragment of a target gene sequence of the insect, and wherein ingestion of the insecticidal polynucleotide by the insect results in mortality or stunting in the insect. In some embodiments, the target gene is selected from the group consisting of actin, Act5C, arginine kinase, COPI (coatomer subunit) alpha, COPI (coatomer subunit) beta, COPI (coatomer subunit) betaPrime, COPI (coatomer subunit) delta, COPI (coatomer subunit) epsilon, COPI (coatomer subunit) gamma, COPI (coatomer subunit) zeta, RpL07, RpL19, RpL3, RpL40, RpL13, RpL14, RpS21, RpS4, RpS14, Rpn2, Rpn3, Rpn7, Rpt6, Rpn8, Rpn9, Rpn6-PB-like protein, Sar1, sec6, sec23, sec23A, shrb (snf7), Tubulin gamma chain, ProsAlpha2, ProsBeta5, Proteasome alpha 2, Proteasome beta 5, VATPase E, VATPase A, VATPase B, VATPase D, Vps2, Vps4, Vps16A, Vps20, Vps24, Vps27, Vps28, Vha26 (V-ATPase A), Vha68-2 (V-ATPase D/E), 40S ribosomal protein S14, and 60S ribosomal protein L13. In some embodiments, the target gene sequence is selected from the group consisting of SEQ ID NOs:1-859. In some embodiments, the insecticidal polynucleotide comprises a sequence of about 95% to about 100% identity or complementarity to at least 21 contiguous nucleotides of a sequence selected from the group consisting of SEQ ID NOs:860-1718 and 1722-1975 or a fragment thereof. In some embodiments, the insecticidal polynucleotide comprises a sequence selected from the group consisting of SEQ ID NOs:860-1718 and 1722-1975. In some embodiments, the insecticidal polynucleotide is provided in the diet of the insect in the form of a plant or bacterial cell containing the polynucleotide, or as a synthetic polynucleotide molecule, or as a fermentation product (e. g., a hairpin form of a dsRNA, produced in a bacterium). In some embodiments, the insecticidal polynucleotide is a single-stranded RNA molecule. In some embodiments, the insecticidal polynucleotide is a double-stranded RNA molecule. In some embodiments, the insecticidal polynucleotide is a single-stranded DNA molecule. In some embodiments, the insecticidal polynucleotide is a double-stranded DNA molecule. In some embodiments, the insecticidal polynucleotide is a RNA/DNA hybrid molecule.

Several embodiments relate to an insecticidal composition comprising an insecticidally effective amount of a polynucleotide, wherein the polynucleotide comprises 18 or more contiguous nucleotides with about 95% to about 100% complementarity with a corresponding portion of a target gene of an insect that infests a plant. In some embodiments, the polynucleotide comprises 21 contiguous nucleotides with a sequence of 100% complementarity with a corresponding portion of the target gene. In some embodiments, the target gene is selected from the group consisting of actin, Act5C, arginine kinase, COPI (coatomer subunit) alpha, COPI (coatomer subunit) beta, COPI (coatomer subunit) betaPrime, COPI (coatomer subunit) delta, COPI (coatomer subunit) epsilon, COPI (coatomer subunit) gamma, COPI (coatomer subunit) zeta, RpL07, RpL19, RpL3, RpL40, RpL13, RpL14, RpS21, RpS4, RpS14, Rpn2, Rpn3, Rpn7, Rpt6, Rpn8, Rpn9, Rpn6-PB-like protein, Sar1, sec6, sec23, sec23A, shrb (snf7), Tubulin gamma chain, ProsAlpha2, ProsBeta5, Proteasome alpha 2, Proteasome beta 5, VATPase E, VATPase A, VATPase B, VATPase D, Vps2, Vps4, Vps16A, Vps20, Vps24, Vps27, Vps28, Vha26 (V-ATPase A), Vha68-2 (V-ATPase D/E), 40S ribosomal protein S14, and 60S ribosomal protein L13. In some embodiments, the polynucleotide comprises 18 or more contiguous nucleotides with about 95% to about 100% complementarity with a DNA sequence selected from the group consisting of SEQ ID NOs:1-859 or a fragment thereof. In some embodiments, the polynucleotide comprises 21 contiguous nucleotides with a sequence of 100% complementarity with a DNA sequence selected from the group consisting of SEQ ID NOs:1-859 or a fragment thereof. In some embodiments, the polynucleotide is a single-stranded RNA molecule. In some embodiments, the polynucleotide is molecule is a dsRNA molecule. In some embodiments, the polynucleotide is a single-stranded DNA molecule. In some embodiments, the polynucleotide is a double-stranded DNA molecule. In some embodiments, the polynucleotide is a RNA/DNA hybrid molecule. In some embodiments, the polynucleotide comprises at least one segment (e. g., an RNA strand or segment of an RNA strand) with a sequence of about 95% to about 100% identity or complementarity with a sequence selected from the group consisting of SEQ ID NOs:860-1718 and 1722-1975 or a fragment thereof. In some embodiments, polynucleotide comprises at least one segment (e. g., an RNA strand or segment of an RNA strand) with a sequence selected from the group consisting of SEQ ID NOs:860-1718 and 1722-1975 or a fragment thereof. In some embodiments, polynucleotide comprises at least one segment of 21 contiguous nucleotides (e. g., an RNA strand or segment of an RNA strand) that is complementary or identical to a sequence selected from the group consisting of SEQ ID NOs:860-1718 and 1722-1975 or a fragment thereof. In some embodiments, the insecticidal composition further comprises one or more of a carrier agent, a surfactant, an organosilicone, a cationic lipid, a polynucleotide herbicidal molecule, a non-polynucleotide herbicidal molecule, a non-polynucleotide pesticide, a fungicide, a safener, an insect attractant, and an insect growth regulator. Embodiments of the insecticidal compositions comprise non-polynucleotide insecticides, e. g., a bacterially produced insecticidal protein.

Several embodiments relate to a method of providing a plant having improved resistance to an insect, comprising expressing in the plant a recombinant DNA construct, wherein the recombinant DNA construct encodes an insecticidal polynucleotide comprising a sequence that is essentially identical or essentially complementary to a fragment of at least one target gene of the insect, and wherein ingestion of the insecticidal polynucleotide by the insect results in mortality or stunting in the insect. In some embodiments, the target gene is selected from the group consisting of actin, Act5C, arginine kinase, COPI (coatomer subunit) alpha, COPI (coatomer subunit) beta, COPI (coatomer subunit) betaPrime, COPI (coatomer subunit) delta, COPI (coatomer subunit) epsilon, COPI (coatomer subunit) gamma, COPI (coatomer subunit) zeta, RpL07, RpL19, RpL3, RpL40, RpL13, RpL14, RpS21, RpS4, RpS14, Rpn2, Rpn3, Rpn7, Rpt6, Rpn8, Rpn9, Rpn6-PB-like protein, Sar1, sec6, sec23, sec23A, shrb (snf7), Tubulin gamma chain, ProsAlpha2, ProsBeta5, Proteasome alpha 2, Proteasome beta 5, VATPase E, VATPase A, VATPase B, VATPase D, Vps2, Vps4, Vps16A, Vps20, Vps24, Vps27, Vps28, Vha26 (V-ATPase A), Vha68-2 (V-ATPase D/E), 40S ribosomal protein S14, and 60S ribosomal protein L13. In some embodiments, the target gene has a DNA sequence selected from the group consisting of SEQ ID NOs:1-859. In some embodiments, the insecticidal polynucleotide is single-stranded RNA (ssRNA). In other embodiments, the insecticidal polynucleotide is double-stranded RNA (dsRNA), which may comprise single-stranded portions, such as a loop in a stem-loop structure. In some embodiments, the insecticidal polynucleotide is a single-stranded DNA molecule. In some embodiments, the insecticidal polynucleotide is a double-stranded DNA molecule. In some embodiments, the insecticidal polynucleotide is a RNA/DNA hybrid molecule. In some embodiments, the insecticidal polynucleotide comprises a sequence of about 95% to about 100% identity or complementarity with a sequence selected from the group consisting of SEQ ID NOs:860-1718 and 1722-1975 or a fragment thereof. In some embodiments, the insecticidal polynucleotide comprises a sequence of at least 21 contiguous nucleotides that are complementarity or identical to a sequence selected from the group consisting of SEQ ID NOs:860-1718 and 1722-1975. In some embodiments, the insecticidal polynucleotide is an RNA (e. g., an RNA strand or segment of an RNA strand) comprising at least 21 contiguous nucleotides of a sequence selected from the group consisting of SEQ ID NOs:860-1718 and 1722-1975 or a fragment thereof.

Several embodiments relate to a recombinant DNA construct comprising a heterologous promoter operably linked to DNA encoding an insecticidal polynucleotide comprising a sequence of about 95% to about 100% identity or complementarity with at least 21 contiguous nucleotides of a sequence selected from the group consisting of SEQ ID NOs:860-1718 and 1722-1975 or a fragment thereof. Several embodiments relate to a commercial unit of seed, such as a bag, in which all or substantially all of the seeds comprise a recombinant DNA construct comprising a heterologous promoter operably linked to DNA encoding an insecticidal polynucleotide comprising a sequence of about 95% to about 100% identity or complementarity with at least 21 contiguous nucleotides of a sequence selected from the group consisting of SEQ ID NOs:860-1718 and 1722-1975 or a fragment thereof. In some embodiments, the insecticidal polynucleotide is single-stranded RNA (ssRNA). In other embodiments, the insecticidal polynucleotide is double-stranded RNA (dsRNA), which may comprise single-stranded portions, such as a loop in a stem-loop structure. In some embodiments, the insecticidal polynucleotide is single-stranded DNA (ssDNA). In other embodiments, the insecticidal polynucleotide is double-stranded DNA (dsDNA), which may comprise single-stranded portions, such as a loop in a stem-loop structure. In some embodiments, the insecticidal polynucleotide is a hybrid RNA/DNA molecule. In some embodiments, the insecticidal polynucleotide comprises an RNA strand or segment of an RNA strand comprising a sequence of about 95% to about 100% identity or complementarity with at least 21 contiguous nucleotides of a sequence selected from the group consisting of SEQ ID NOs:860-1718 and 1722-1975 or a fragment thereof. In some embodiments, the insecticidal polynucleotide comprises an RNA strand or segment of an RNA strand comprising a sequence selected from the group consisting of SEQ ID NOs:860-1718 and 1722-1975 or a fragment thereof.

In related aspects, provided herein are man-made compositions comprising a insecticidal polynucleotide as described herein, such as ssRNA, dsRNA, ssDNA, dsDNA or hybrid RNA/DNA formulations useful for topical application to a plant or substance in need of protection from an insect infestation; recombinant constructs and vectors useful for making transgenic plant cells and transgenic plants; formulations and coatings useful for treating plants (including plant seeds or propagatable parts such as tubers); plant seeds or propagatable parts such as tubers treated with or containing a polynucleotide as described herein as well as commodity products and foodstuffs produced from such plants; seeds; or propagatable parts (especially commodity products and foodstuffs having a detectable amount of a polynucleotide disclosed herein). Several embodiments relate to polyclonal or monoclonal antibodies that bind a peptide or protein encoded by a sequence or a fragment of a sequence selected from the group consisting of SEQ ID NOs:1-859. Several embodiments relate to polyclonal or monoclonal antibodies that bind a peptide or protein encoded by a sequence or a fragment of a sequence selected from the group consisting of SEQ ID NOs:860-1718 and 1722-1975 or the complement thereof. Such antibodies are made by routine methods as known to one of ordinary skill in the art.

DETAILED DESCRIPTION

The present embodiments relate to methods and compositions for controlling insect pests, in particular the group of coleopteran insects commonly known as "flea beetles", of which there are several genera. Disclosed herein are target genes identified as useful for designing insecticidal polynucleotide agents for preventing or treating flea beetle infestations, especially of commercially important plants. The methods and compositions are especially useful for preventing or treating flea beetle infestations of commercially important *Brassica* species including species commercially used as oilseed, food, or livestock feed (e. g., canola, rapeseed, turnips, and field mustard or turnip rape). Such *Brassica* species include *B. napus, B. juncea, B. carinata, B. rapa, B. oleracea, B. rupestris, B. sepficeps, B. nigra, B. narinosa, B. perviridus, B. toumefortii*, and *B. frucficulosa*. Also disclosed are sequences for suppressing one or more flea beetle target genes. Several embodiments relate to insecticidal polynucleotide agents that suppress flea beetle target genes. In some embodiments, insecticidal polynucleotides and recombinant DNA molecules and constructs useful in methods of controlling insect pests, especially flea beetles are provided. Several embodiments relate to insecticidal compositions, as well as to transgenic plants resistant to infestation by insect pests. Several embodiments relate to methods of identifying efficacious insecticidal polynucleotide agents, for example, single-stranded RNA molecules, double-stranded RNA molecules, single-stranded DNA molecules, double-stranded DNA molecules, or hybrid RNA/DNA molecules for controlling insect pests and methods for identifying target genes that are likely to represent essential functions, making these genes preferred targets for RNAi-mediated silencing and control of insect pests.

Several embodiments relate to methods and compositions for inhibiting or controlling flea beetle infestation of a plant by inhibiting in the flea beetle the expression of one or more target gene selected from the group consisting of actin, Act5C, arginine kinase, COPI (coatomer subunit) alpha, COPI (coatomer subunit) beta, COPI (coatomer subunit) betaPrime, COPI (coatomer subunit) delta, COPI (coatomer subunit) epsilon, COPI (coatomer subunit) gamma, COPI (coatomer subunit) zeta, RpL07, RpL19, RpL3, RpL40, RpL13, RpL14, RpS21, RpS4, RpS14, Rpn2, Rpn3, Rpn7, Rpt6, Rpn8, Rpn9, Rpn6-PB-like protein, Sar1, sec6, sec23, sec23A, shrb (snf7), Tubulin gamma chain, ProsAlpha2, ProsBeta5, Proteasome alpha 2, Proteasome beta 5, VATPase E, VATPase A, VATPase B, VATPase D, Vps2, Vps4, Vps16A, Vps20, Vps24, Vps27, Vps28, Vha26 (V-ATPase A), Vha68-2 (V-ATPase D/E), 40S ribosomal protein S14, and 60S ribosomal protein L13. In some embodiments, inhibiting the expression of one or more target gene in the flea beetle results in stunting or mortality.

Several embodiments relate to an insecticidal polynucleotide molecule, such as a ssRNA, a dsRNA, a ssDNA, a dsDNA, or a RNA/DNA hybrid, which comprises one or more segments comprising 18 or more contiguous nucleotides, for example 21 or more contiguous nucleotides, having 95% to about 100% (e. g., about 95%, about 96%, about 97%, about 98%, about 99%, or about 100%) complementarity with a fragment of an insect target gene selected from the group consisting of actin, Act5C, arginine kinase, COPI (coatomer subunit) alpha, COPI (coatomer subunit) beta, COPI (coatomer subunit) betaPrime, COPI (coatomer subunit) delta, COPI (coatomer subunit) epsilon, COPI (coatomer subunit) gamma, COPI (coatomer subunit) zeta, RpL07, RpL19, RpL3, RpL40, RpL13, RpL14, RpS21, RpS4, RpS14, Rpn2, Rpn3, Rpn7, Rpt6, Rpn8, Rpn9, Rpn6-PB-like protein, Sar1, sec6, sec23, sec23A, shrb (snf7), Tubulin gamma chain, ProsAlpha2, ProsBeta5, Proteasome alpha 2, Proteasome beta 5, VATPase E, VATPase A, VATPase B, VATPase D, Vps2, Vps4, Vps16A, Vps20, Vps24, Vps27, Vps28, Vha26 (V-ATPase A), Vha68-2 (V-ATPase D/E), 40S ribosomal protein S14, and 60S ribosomal protein L13. In some embodiments, the insecticidal polynucleotide comprises multiple segments each of 18 or more contiguous nucleotides with a sequence of about 95% to about 100% (e. g., about 95%, about 96%, about 97%, about 98%, about 99%, or about 100%) complementarity with a fragment of a DNA sequence selected from the group consisting of SEQ ID NOs:1-859. In some embodiments, the insecticidal polynucleotide comprises at least 21 contiguous nucleotides having 100% complementarity with a fragment of a DNA sequence selected from the group consisting of SEQ ID NOs:1-859. In some embodiments, the insecticidal polynucleotide comprises segments complementary to different regions of a target gene, or can comprise multiple copies of a segment. In some embodiments, the insecticidal polynucleotide comprises multiple segments, each of 18 or more contiguous nucleotides with a sequence of about 95% to about 100% (e. g., about 95%, about 96%, about 97%, about 98%, about 99%, or about 100%) complementarity with a fragment of a different target gene; in this way multiple target genes, or multiple insect species, can be suppressed.

Several embodiments relate to a insecticidal polynucleotide (e.g., a ssRNA, a dsRNA, a ssDNA, a dsDNA, or a RNA/DNA hybrid) molecule which inhibits the expression of one or more insect target genes selected from the group consisting of actin, Act5C, arginine kinase, COPI (coatomer subunit) alpha, COPI (coatomer subunit) beta, COPI (coatomer subunit) betaPrime, COPI (coatomer subunit) delta, COPI (coatomer subunit) epsilon, COPI (coatomer subunit) gamma, COPI (coatomer subunit) zeta, RpL07, RpL19, RpL3, RpL40, RpL13, RpL14, RpS21, RpS4, RpS14, Rpn2, Rpn3, Rpn7, Rpt6, Rpn8, Rpn9, Rpn6-PB-like protein, Sar1, sec6, sec23, sec23A, shrb (snf7), Tubulin gamma chain, ProsAlpha2, ProsBeta5, Proteasome alpha 2, Proteasome beta 5, VATPase E, VATPase A, VATPase B, VATPase D, Vps2, Vps4, Vps16A, Vps20, Vps24, Vps27, Vps28, Vha26 (V-ATPase A), Vha68-2 (V-ATPase D/E), 40S ribosomal protein S14, and 60S ribosomal protein L13. Several embodiments relate to an insecticidal polynucleotide having a length greater than that which is typical of naturally occurring regulatory small RNAs (such as endogenously produced siRNAs and mature miRNAs), e. g, the polynucleotide is at least about 30 contiguous base-pairs in length. In some embodiments, the insecticidal polynucleotide has a length of between about 50 to about 500 base-pairs. In some embodiments, the insecticidal polynucleotide is at least 50 base pairs in length. In some embodiments, the insecticidal polynucleotide is formed from two separate, essentially complementary strands (e. g., where each strand is separately provided, or where each strand is encoded on a separate DNA molecule, or where the two strands are encoded on separate sections of a DNA and are separately transcribed or made separate, for example, by the action of a recombinase or nuclease), wherein at least one strand comprises a sequence of about 95% to about 100% (e. g., about 95%, about 96%, about 97%, about 98%, about 99%, or about 100%) identity or complementarity with at least 21 contiguous nucleotides of a sequence selected from the group consisting of SEQ ID NOs:860-1718 and 1722-1975 or a fragment thereof. In some embodiments, the insecticidal polynucleotide is double stranded and blunt-ended, e. g., two separate, equal-length strands which form the double-stranded polynucleotide through intermolecular hybridisation. In some embodiments, the insecticidal polynucleotide is double stranded and has an overhang at one or both ends (termini), e. g., two separate, unequal-length strands which form the double-stranded polynucleotide through intermolecular hybridisation; the overhang can be a single nucleotide or 2, 3, 4, 5, 6, or more nucleotides, and can be located on the 5' end or on the 3' end of a strand. In some embodiments, the insecticidal polynucleotide comprises at least one stem-loop, e. g., a single polynucleotide molecule that forms a double-stranded region through intramolecular hybridization adjacent to a "hairpin" secondary structure. In some embodiments, the insecticidal polynucleotide is formed from a single self-hybridizing hairpin, wherein one "arm" of the hairpin comprises a sequence of about 95% to about 100% (e. g., about 95%, about 96%, about 97%, about 98%, about 99%, or about 100%) identity or complementarity to at least 21 contiguous nucleotides of a sequence selected from the group consisting of SEQ ID NOs:860-1718 and 1722-1975 or a fragment thereof. In embodiments, self-hybridizing polynucleotides which form hairpins (or partial hairpins) include polynucleotide molecules that comprise "spacer" nucleotides or a single-stranded "loop region" between the double-strand-forming complementary "arms" of sense sequence and anti-sense sequence. In embodiments, such spacers or loops include nucleotides having a sequence unrelated (not complementary or identical to) the target gene corresponding to the double-stranded portion of the hairpin. In embodiments, such spacers or loops include nucleotides having a sequence complementary or identical to the target gene. Examples of spacers or loops include those encoded by SEQ ID NOs:1719-1721. In embodiments, the insecticidal polynucleotide comprises multiple stem-loops, with or without spacer nucleotides between each stem-loop. In embodiments, the insecticidal polynucleotide comprises a modified stem-loop such as a "stabilized anti-sense" loop or a "stabilized sense" loop; see, e. g., U.S. Pat. Nos. 7,855,323 and 9,006,414, which are incorporated by reference in their entirety herein.

The insecticidal polynucleotide can be chemically synthesized (e. g., by in vitro transcription, such as transcription using a T7 polymerase or other polymerase), or can be produced by expression in a microorganism, by expression in a plant cell, or by microbial fermentation. The insecticidal polynucleotide can be chemically modified, e. g., to improve stability, ease of formulation, or efficacy. In some embodiments, the insecticidal polynucleotide molecule is provided in a microbial or plant cell that expresses the insecticidal polynucleotide (such as a hairpin form of a dsRNA), or in a microbial fermentation product.

A variety of methods for designing and producing a variety of forms of insecticidal polynucleotide are known in the art and are useful in the compositions and methods disclosed herein. See, for example, the following patents which are incorporated by reference in their entirety herein: (1) U.S. Pat. No. 8,598,332 to Waterhouse et al., which discloses recombinant DNA constructs comprising DNA encoding sense RNA and anti-sense RNA sequences in a single transcript that forms an artificial "hairpin" RNA structure with a double-stranded RNA stem by base-pairing between the sense and anti-sense nucleotide sequences; embodiments include hairpins with spacer nucleotides between the sense and anti-sense nucleotide sequences; (2) U.S. Pat. No. 8,158,414 to Rommens et al., which discloses recombinant DNA constructs including convergently oriented first and second promoters, which produce, e. g., an RNA duplex that is formed by annealing of two separate RNA transcripts; and (3) U.S. Pat. Nos. 7,855,323 and 9,006,414 to Huang et al., which disclose recombinant DNA constructs including DNA encoding "stabilized anti-sense" transcripts which form a loop of anti-sense-oriented RNA for suppressing one or more target genes; recombinant DNA constructs can be designed to similarly encode "stabilized sense" transcripts which form a loop of sense-oriented RNA for suppressing one or more target genes.

Embodiments of the compositions comprising insecticical polynucleotides described herein further comprise one or more additional components or adjuvants, e. g., a carrier agent, an encapsulation agent, an emulsifying agent, a surfactant, an organosilicone, a cationic lipid, a spreading agent, a photoprotective agent, a rainfastness agent, a polynucleotide herbicidal molecule, a non-polynucleotide herbicidal molecule, a non-polynucleotide pesticide, a non-polynucleotide fungicide, a safener, a bait, an insect attractant, an insect pheromone, and an insect growth regulator. In embodiments, these additional components or adjuvants are edible or digestible if ingested by a flea beetle.

In embodiments, the insecticidal polynucleotide disclosed herein are used in combination with a non-nucleotide pesticidal agent such as a small-molecule pesticidal agent or a proteinaceous pesticidal agent, either concurrently or sequentially. Examples of non-nucleotide pesticidal agents include patatins, plant lectins, phytoecdysteroids, and bacterial insecticidal proteins (e. g., insecticidal proteins from *Bacillus thuringiensis, Xenorhabdus* sp., *Photorhabdus* sp., *Brevibacillus laterosporus* (previously *Bacillus laterosporus*), *Lysinibacillus sphaericus* (previously *Bacillus sphaericus*), *Chromobacterium* sp., *Chromobacterium subtsugae, Paenibacillus* sp., *Paenibacillus lentimorbus*, and *Paenibacillus popilliae*), a bacterium that produces an insecticidal protein, and an entomicidal bacterial species. In embodiments, the compositions comprising polynucleotides for flea beetle control such as the insecticidal polynucleotide described herein can further comprise, or can be used concurrently or sequentially with, conventional pesticides such as Spiromesifen, Spirodiclofen, Spirotetramat, Pyridaben, Tebufenpyrad, Tolfenpyrad, Fenpyroximate, Flufenerim, Pyrimidifen, Fenazaquin, Rotenone, Cyenopyrafen, Hydramethylnon, Acequinocyl, Fluacrypyrim, Aluminium phosphide, Calcium phosphide, Phosphine, Zinc phosphide, Cyanide, Diafenthiuron, Azocyclotin, Cyhexatin, Fenbutatin oxide, Propargite, Tetradifon, Bensultap, Thiocyclam, Thiosultap-sodium, Flonicamid, Etoxazole, Clofentezine, Diflovidazin, Hexythiazox, Chlorfluazuron, Bistrifluron, Diflubenzuron, Flucycloxuron, Flufenoxuron, Hexaflumuron, Lufenuron, Novaluron, Noviflumuron, Tefluben-zuron, Triflumuron, Buprofezin, Cyromazine, Hydroprene, Kinoprene, Methoprene, Fenoxycarb, Pyriproxyfen, Pymetrozine, Pyrifluquinazon, Chlorfenapyr, Tralopyril, B. t. (*Bacillus thuringiensis*) var. *aizawai*, B.t. var. *israelensis*, B.t. var. *kurstaki*, B.t. var. *sphaericus*, B.t. var. *tenebrionensis, Bacillus thuringiensis* crop proteins including Cry1Ab, Cry1Ac, Cry1Fa, Cry2Ab, mCry3A, Cry3Ab, Cry3Bb, Cry34/35Ab1, Methyl bromide and other alkyl halides, Chloropicrin, Sulfuryl fluoride, Benclothiaz, Chinomethionat, Cryolite, Methylneodecanamide, Benzoximate, Cymiazole, Fluensulfone, Azadirachtin, Bifenazate, Amidoflumet, Dicofol, Plifenate, Cyflumetofen, Pyridalyl, *Beauveria bassiana* GHA, Sulfoxaflor, Spinetoram, Spinosad, Spinosad, Emamectin benzoate, Lepimectin, Milbemectin, Abamectin, Methoxyfenozide, Chromafenozide, Halofenozide, Tebufenozide, Amitraz, Chlorantraniliprole, Cyantraniliprole, Flubendiamide, alpha-endosulfan, Chlordane, Endosulfan, Fipronil, Acetoprole, Ethiprole, Pyrafluprole, Pyriprole, Indoxacarb and Metaflumizone, Acrinathrin, Allethrin, Allethrin-cis-trans, Allethrin-trans, beta-Cyfluthrin, beta-Cypermethrin, Bifenthrin, Bioallethrin, Bioallethrin S-cyclopentenyl, Bioresmethrin, Cycloprothrin, Cyfluthrin, Cyhalothrin, Cypermethrin, Cyphenothrin [(1R)-trans-isomers], Dimefluthrin, Empenthrin [(EZ)-(1R)-isomers], Esfenvalerate, Etofenprox, Fenpropathrin, Fenvalerate, Flucythrinate, Flumethrin, Gamma-cyhalothryn, lambda-Cyhalothrin, Meperfluthrin, Metofluthrin, Permethrin, Phenothrin [(1R)-trans-isomer], Prallethrin, Profluthrin, Protrifenbute, Resmethrin, Silafluofen, tau-Fluvalinate, Tefluthrin, Tetramethrin, Tetramethrin [(1R)-isomers], Tetramethylfluthrin, theta-Cypermethrin, Tralomethrin, Transfluthrin, zeta-Cypermethrin, alpha-Cypermethrin, Deltamethrin, DDT, and Methoxychlor, Thiodicarb, Alanycarb, Aldicarb, Bendiocarb, Benfuracarb, Butoxycarboxim, Carbaryl, Carbofuran, Carbosulfan, Ethiofencarb, Fenobucarb, Formetanate, Furathiocarb, Isoprocarb, Methiocarb, Methomyl, Metolcarb, Oxamyl, Pirimicarb, Propoxur, Thiofanox, Triazamate, Trimethacarb, XMC, Xylylcarb, Chlorpyrifos, Malathion, Acephate, Azamethiphos, Azinphos-ethyl, Azinphos-methyl, Cadusafos, Chlorethoxyfos, Chlorfenvinphos, Chlormephos, Chlorpyrifos-methyl, Coumaphos, Cyanophos, Demeton-S-methyl, Diazinon, Dichlorvos/DDVP, Dicrotophos, Dimethoate, Dimethylvinphos, Disulfoton, EPN, Ethion, Ethoprophos, Famphur, Fenamiphos, Fenitrothion, Fenthion, Fonofos, Fosthiazate, Imicyafos, Isofenphos-methyl, Mecarbam, Methamidophos, Methidathion, Mevinphos, Monocrotophos, Naled, Omethoate, Oxydemeton-methyl, Parathion, Parathion-methyl, Phenthoate, Phorate, Phosalone, Phosmet, Phosphamidon, Phoxim, Pirimiphos-ethyl, Profenofos, Propaphos, Propetamphos, Prothiofos, Pyraclofos, Pyridaphenthion, Quinalphos, Sulfotep, Tebupirimfos, Temephos, Terbufos, Tetrachlorvinphos, Thiometon, Triazophos, Trichlorfon, Vamidothion Imidacloprid, Thiamethoxam, Acetamiprid, Clothianidin, Dinotefuran, Nitenpyram, Nithiozine, Nicotine, Thiacloprid, chlorantraniliprole, and cyantraniliprole. In embodiments, the compositions comprising insecticidal polynucleotide for flea beetle control in *Brassica* species, including canola, further comprise, or are used concurrently or sequentially with, foliar sprays including one or more pesticides selected from the group consisting of Deltamethrin, Cypermethrin, Lambda-cyhalothrin, Permethrin, Carbaryl, Carbofuran, and Malathion, or seed treatments comprising one or more pesticides selected from the group consisting of Thiamethoxam, Imidacloprid, and Clothianadin.

In embodiments, the compositions comprising insecticidal polynucleotides for flea beetle control described herein can further comprise, or can be used concurrently or sequentially with, conventional fungicides such as bupirimate, dimethirimol, ethirimol, cyprodinil, pyrimethanil, mepanipyrim, fenpiclonil, fludioxonil; phenylamides, benalaxyl, furalaxyl, metalaxyl, R-metalaxyl, ofurace, oxadixyl, benomyl, carbendazim, debacarb, fuberidazole, thiabendazole, chlozolinate, dichlozoline, iprodine, myclozoline, procymidone, vinclozolin, carboxin, fenfuram, flutolanil, mepronil, oxycarboxin, thifluzamide, guazatine, dodine, iminoctadine, azoxystrobin, kresoxim-methyl, metominostrobin, or trifloxystrobin, ferbam, mancozeb, maneb, metiram, propineb, thiram, zineb, ziram, captafol, captan, dichlofluanid, fluoromide, folpet, tolyfluanid, copper hydroxide, copper oxychloride, copper sulfate, cuprous oxide, mancopper, oxine-copper, dinocap, nitrothal-isopropyl, edifenphos, iprobenphos, isoprothiolane, phosdiphen, pyrazopho, toclofos-methyl, acibenzolar-S-methyl, harpin, anilazine, blasticidin-S, chinomethionat, chloroneb, chlorothalonil, cymoxanil, dichione, diclomezine, dicloran, diethofencarb, dimethomorph, dithianon, etridiazole, famoxadone, fenamidone, fentin, fenpyrazamine, ferimzone, fluazinam, flusulfamide, fosetyl-aluminium, hymexazol, kasugamycin, methasulfocarb, pencycuron, phthalide, polyoxins, probenazole, propamocarb, pyroquilon, quinoxyfen, quintozene, sulfur, triazoxide, tricyclazole, validamycin, azaconazole, bitertanol, propiconazole, difenoconazole, diniconazole, cyproconazole, epoxiconazole, fluquinconazole, flusilazole, flutriafol, hexaconazole, imazalil, imibenconazole, ipconazole, tebuconazole, tetraconazole, fenbuconazole, metconazole, myclobutanil, perfurazoate, penconazole, bromuconazole, pyrifenox, prochloraz, triadimefon, triadimenol, triflumizol, triticonazole, triforine, ancymidol, fenarimol or nuarimol, dodemorph, fenpropidin, fenpropimorph, spiroxamine, tridemorph, and fenhexamid. In embodiments, the compositions comprising insecticidal polynucleotides for flea beetle control in *Brassica* species, including canola, further comprise, or are used concurrently or sequentially with, foliar sprays including one or more fungicides selected from the group consisting of Azoxystrobin, *Bacillus subtilis* strain QST 2808, Boscalid, Fluxopyroxad, Pyraclostrobin, Metconazole, Prothioconazole, Penthiopyrad, Picoxystrobin, and Thiophanate Methyl, or seed treatments including one or more fungicides selected from the group consisting of Azoxystrobin, Metalaxyl, Trifloxystrobin, Pyraclostrobin, Sedaxane, Penflufen, Fludioxonil, and Mefenoxam.

In embodiments, the compositions comprising insecticidal polynucleotides for flea beetle described herein can further comprise, or can be used concurrently or sequentially with, conventional herbicides such as glyphosate, auxin-like herbicides such as dicamba, phosphinothricin, glufosinate, 2,2-dichloropropionic acid (Dalapon), acetolactate synthase inhibitors such as sulfonylurea, imidazolinone, triazolopyrimidine, pyrimidyloxybenzoates, and phthalide, bromoxynil, cyclohexanedione (sethoxydim) and aryloxyphenoxypropionate (haloxyfop), sulfonamide herbicides, triazine herbicides, 5-methyltryptophan, aminoethyl cysteine, pyridazinone herbicides such as norflurazon, cyclopropylisoxazole herbicides such as isoxaflutole, protoporphyrinogen oxidase inhibitors, herbicidea containing an aryloxyalkanoate moiety, phenoxy auxins such as 2,4-D and dichlorprop, pyridyloxy auxins such as fluroxypyr and triclopyr, aryloxyphenoxypropionates (AOPP) acetyl-coenzyme A carboxylase (ACCase) inhibitors such as haloxyfop, quizalofop, and diclofop, and 5-substituted phenoxyacetate protoporphyrinogen oxidase IX inhibitors such as pyraflufen and flumiclorac. In embodiments, the compositions comprising insecticidal polynucleotides for flea beetle control in *Brassica* species, including canola, further comprise, or are used concurrently or sequentially with, one or more post-emergence herbicides selected from the group consisting of Quizalofop, Sethoxydim, Clethodim, and Clopyralid. In embodiments, the compositions comprising insecticidal polynucleotides for flea beetle control in herbicide-resistant *Brassica* species, including herbicide-resistant canola, further comprise, or are used concurrently or sequentially with, one or more herbicides selected from the group consisting of Imazamox, Glyphosate, and Glufosinate.

The compositions and methods disclosed are useful for inhibiting or controlling flea beetle infestation of a plant, such as a *Brassica* species. In embodiments, the compositions and methods are used to treat a growing plant, such as a field of *Brassica* plants. Embodiments include compositions comprising insecticidal polynucleotides disclosed herein in a composition in the form of a solid, liquid, powder, suspension, emulsion, spray, encapsulation, microbeads, carrier particulates, film, matrix, soil drench, or seed treatment composition. In embodiments, such compositions are applied to a surface of the plant in need of protection from or treatment for flea beetle infestations, or applied directly to the flea beetles, or provided in an ingestible form to the flea beetles. In embodiments, a composition comprising insecticidal polynucleotides disclosed herein is applied directly to ungerminated seeds (such as ungerminated *Brassica* species seeds), providing plants germinated from the treated seeds increased resistance to flea beetle infestations; examples of seed treatment methods are disclosed in U.S. Patent Publication No. 2014/0230090 A1, which is incorporated by reference in its entirety herein. An embodiment includes a *Brassica* seed that is treated by directly contacting the seed with an insecticidal polynucleotide (such as a ssRNA, dsRNA, ssDNA, dsDNA or RNA/DNA hybrid molecule) disclosed herein, followed by germination into a *Brassica* plant that exhibits increased resistance to flea beetle infestations.

Unless defined otherwise, all technical and scientific terms used have the same meaning as commonly understood by one of ordinary skill in the art. Generally, the nomenclature used and the manufacturing or laboratory procedures described below are well known and commonly employed in the art. Conventional methods are used for these procedures, such as those provided in the art and various general references. Where a term is provided in the singular, the inventors also contemplate aspects described by the plural of that term. Where there are discrepancies in terms and definitions used in references that are incorporated by reference, the terms used in this application shall have the definitions given. Other technical terms used have their ordinary meaning in the art in which they are used, as exemplified by various art-specific dictionaries, for example, "The American Heritage® Science Dictionary" (Editors of the American Heritage Dictionaries, 2011, Houghton Mifflin Harcourt, Boston and New York), the "McGraw-Hill Dictionary of Scientific and Technical Terms" ($6^{th}$ edition, 2002, McGraw-Hill, New York), or the "Oxford Dictionary of Biology" ($6^{th}$ edition, 2008, Oxford University Press, Oxford and New York). The inventors do not intend to be limited to a mechanism or mode of action. Reference thereto is provided for illustrative purposes only.

Unless otherwise stated, nucleic acid sequences in the text of this specification are given, when read from left to right, in the 5' to 3' direction. One of skill in the art would be aware that a given DNA sequence is understood to define a corresponding RNA sequence which is identical to the DNA sequence except for replacement of the thymine (T) nucleotides of the DNA with uracil (U) nucleotides. Thus, providing a specific DNA sequence is understood to define the RNA equivalent and vice versa. A given first polynucleotide sequence, whether DNA or RNA, further defines the sequence of its exact complement (which can be DNA or RNA), i. e., a second polynucleotide that hybridizes perfectly to the first polynucleotide by forming Watson-Crick base-pairs. By "essentially complementary" is meant that a polynucleotide strand (or at least one strand of a double-stranded polynucleotide) is designed to hybridize (generally under physiological conditions such as those found in a living plant or animal cell) to a target gene or to a fragment of a target gene or to the transcript of the target gene or the fragment of a target gene; one of skill in the art would understand that such hybridization does not necessarily require 100% sequence complementarity. A first nucleic acid sequence is "operably" connected or "linked" with a second nucleic acid sequence when the first nucleic acid sequence is placed in a functional relationship with the second nucleic acid sequence. For example, a promoter sequence is "operably linked" to DNA if the promoter provides for transcription or expression of the DNA. Generally, operably linked DNA sequences are contiguous.

The term "polynucleotide" commonly refers to a DNA or RNA molecule containing multiple nucleotides and generally refers both to "oligonucleotides" (a polynucleotide molecule of 18-25 nucleotides in length) and longer polynucleotides of 26 or more nucleotides. Polynucleotides also include molecules containing multiple nucleotides, including non-canonical nucleotides or chemically modified nucleotides as commonly practiced in the art; see, e. g., chemical modifications disclosed in the technical manual "RNA Interference (RNAi) and DsiRNAs", 2011 (Integrated DNA Technologies Coralville, Iowa).

Generally, insecticidal polynucleotides as described herein, whether DNA or RNA or both, and whether single- or double-stranded, comprise at least one segment of 18 or more contiguous nucleotides (or, in the case of double-stranded polynucleotides, at least 18 contiguous base-pairs) that are essentially identical or complementary to a fragment of equivalent size of the DNA of a target gene or the target gene's RNA transcript. Throughout this disclosure, "at least 18 contiguous" means "from about 18 to about 10,000, including every whole number point in between". Thus, embodiments include compositions comprising oligonucleotides having a length of 18-25 nucleotides (18-mers, 19-mers, 20-mers, 21-mers, 22-mers, 23-mers, 24-mers, or 25-mers), or medium-length polynucleotides having a length of 26 or more nucleotides (polynucleotides of 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, about 65, about 70, about 75, about 80, about 85, about 90, about 95, about 100, about 110, about 120, about 130, about 140, about 150, about 160, about 170, about 180, about 190, about 200, about 210, about 220, about 230, about 240, about 250, about 260, about 270, about 280, about 290, or about 300 nucleotides), or long polynucleotides having a length greater than about 300 nucleotides (e. g., polynucleotides of between about 300 to about 400 nucleotides, between about 400 to about 500 nucleotides, between about 500 to about 600 nucleotides, between about 600 to about 700 nucleotides, between about 700 to about 800 nucleotides, between about 800 to about 900 nucleotides, between about 900 to about 1000 nucleotides, between about 300 to about 500 nucleotides, between about 300 to about 600 nucleotides, between about 300 to about 700 nucleotides, between about 300 to about 800 nucleotides, between about 300 to about 900 nucleotides, or about 1000 nucleotides in length, or even greater than about 1000 nucleotides in length, for example up to the entire length of a target gene including coding or non-coding or both coding and non-coding portions of the target gene). Where an insecticidal polynucleotide is double-stranded, such as the dsRNAs described in the working Examples, its length can be similarly described in terms of base pairs. Double-stranded insecticidal polynucleotides can further be described in terms of one or more of the single-stranded components.

The insecticidal polynucleotides described herein can be single-stranded (ss) or double-stranded (ds). "Double-stranded" refers to the base-pairing that occurs between sufficiently complementary, anti-parallel nucleic acid strands to form a double-stranded nucleic acid structure, generally under physiologically relevant conditions. Embodiments include those wherein the polynucleotide is selected from the group consisting of sense single-stranded DNA (ssDNA), sense single-stranded RNA (ssRNA), double-stranded RNA (dsRNA), double-stranded DNA (dsDNA), a double-stranded DNA/RNA hybrid, anti-sense ssDNA, or anti-sense ssRNA; a mixture of polynucleotides of any of these types can be used. In some embodiments, the insecticidal polynucleotide is double-stranded RNA of a length greater than that which is typical of naturally occurring regulatory small RNAs (such as endogenously produced siRNAs and mature miRNAs). In some embodiments, the insecticidal polynucleotide is double-stranded RNA of at least about 30 contiguous base-pairs in length. In some embodiments, the insecticidal polynucleotide is double-stranded RNA with a length of between about 50 to about 500 base-pairs. In some embodiments, the insecticidal polynucleotide can comprise components other than standard ribonucleotides, e. g., an embodiment is an RNA that comprises terminal deoxyribonucleotides.

Insecticidal polynucleotides of any size can be used, alone or in combination, in the various methods and compositions described herein. In some embodiments, a single insecticidal polynucleotide is used to make a composition (e. g., a composition for topical application). In other embodiments, a mixture or pool of different insecticidal polynucleotides is used; in such cases the insecticidal polynucleotides can be for a single target gene or for multiple target genes.

In various embodiments, an insecticidal polynucleotide as described herein comprises naturally occurring nucleotides, such as those which occur in DNA and RNA. In certain embodiments, the insecticidal polynucleotide is a combination of ribonucleotides and deoxyribonucleotides, for example, synthetic polynucleotides consisting mainly of ribonucleotides but with one or more terminal deoxyribonucleotides or one or more terminal dideoxyribonucleotides or synthetic polynucleotides consisting mainly of deoxyribonucleotides but with one or more terminal dideoxyribonucleotides. In certain embodiments, the insecticidal polynucleotide comprises non-canonical nucleotides such as inosine, thiouridine, or pseudouridine. In certain embodiments, the insecticidal polynucleotide comprises chemically modified nucleotides. Examples of chemically modified oligonucleotides or polynucleotides are well known in the art; see, for example, U.S. Patent Publication 2011/0171287, U.S. Patent Publication 2011/0171176, U.S. Patent Publication 2011/0152353, U.S. Patent Publication 2011/0152346, and U.S. Patent Publication 2011/0160082, which are herein incorporated by reference. Illustrative examples include, but are not limited to, the naturally occurring phosphodiester backbone of an oligonucleotide or polynucleotide which can be partially or completely modified with phosphorothioate, phosphorodithioate, or methylphosphonate internucleotide linkage modifications, modified nucleoside bases or modified sugars can be used in oligonucleotide or polynucleotide synthesis, and oligonucleotides or polynucleotides can be labeled with a fluorescent moiety (e. g., fluorescein or rhodamine) or other label (e. g., biotin).

The term "recombinant", as used to refer to a polynucleotide (such as insecticidal polynucleotide molecules or recombinant DNA constructs described herein), means that the polynucleotide is not a naturally occurring molecule, i. e., that human intervention is required for the polynucleotide to exist. A recombinant polynucleotide is produced using recombinant nucleic acid techniques, or by chemical synthesis, and can include combinations of sequences that do not occur in nature (e. g., combinations of a heterologous promoter and a DNA encoding an RNA to be expressed, or an RNA molecule that comprises concatenated segments of a target gene that do not in nature occur adjacent to one another). A recombinant polynucleotide can be biologically produced in a cell (such as a bacterial or plant or animal cell), for example, when that cell is transfected or transformed with a vector encoding the recombinant polynucleotide (e. g., a vector encoding a hairpin form of a dsRNA, produced in a bacterium). A recombinant polynucleotide can comprise sequences of nucleotides designed in silico using appropriate algorithms.

The insecticidal polynucleotides disclosed herein are generally designed to suppress or silence one or more genes ("target genes"). The term "gene" refers to any portion of a nucleic acid that provides for expression of a transcript or encodes a transcript, or that is a hereditable nucleic acid sequence. A "gene" can include, but is not limited to, a promoter region, 5' untranslated regions, transcript encoding regions that can include intronic regions, 3' untranslated regions, or combinations of these regions. In embodiments, the target genes can include coding or non-coding sequence or both. In other embodiments, the target gene has a sequence identical to or complementary to a messenger RNA, e. g., in embodiments the target gene is a cDNA.

As used herein, the term "isolated" refers to separating a molecule from other molecules normally associated with it in its native or natural state. The term "isolated" thus may refer to a DNA molecule that has been separated from other DNA molecule(s) which normally are associated with it in its native or natural state. Such a DNA molecule may be present in a recombined state, such as a recombinant DNA molecule. Thus, DNA molecules fused to regulatory or coding sequences with which they are not normally associated, for example as the result of recombinant techniques, are considered isolated, even when integrated as a transgene into the chromosome of a cell or present with other DNA molecules.

By "insecticidally effective" is meant effective in inducing a physiological or behavioural change in an insect (e. g., adult or larval flea beetles) that infests a plant such as, but not limited to, growth stunting, increased mortality, decrease in reproductive capacity or decreased fecundity, decrease in or cessation of feeding behavior or movement, or decrease in or cessation of metamorphosis stage development. In some embodiments, application of an insecticidally effective amount of the insecticidal polynucleotide, such as a dsRNA molecule, to a plant improves the plant's resistance to infestation by the insect. In some embodiments, application of an insecticidally effective amount of the insecticidal polynucleotide to a crop plant improves yield (e. g., increased biomass, increased seed or fruit production, or increased oil, starch, sugar, or protein content) of that crop plant, in comparison to a crop plant not treated with the insecticidal polynucleotide. While there is no upper limit on the concentrations and dosages of an insecticidal polynucleotide as described herein that can be useful in the methods and compositions provided herein, lower effective concentrations and dosages will generally be sought for efficiency and economy. Non-limiting embodiments of effective amounts of an insecticidal polynucleotide include a range from about 10 nanograms per milliliter to about 100 micrograms per milliliter of an insecticidal polynucleotide in a liquid form sprayed on a plant, or from about 10 milligrams per acre to about 100 grams per acre of polynucleotide applied to a field of plants, or from about 0.001 to about 0.1 microgram per milliliter of polynucleotide in an artificial diet for feeding the insect. Where compositions as described herein are topically applied to a plant, the concentrations can be adjusted in consideration of the volume of spray or treatment applied to plant leaves or other plant part surfaces, such as flower petals, stems, tubers, fruit, anthers, pollen, leaves, roots, or seeds. In one embodiment, a useful treatment for herbaceous plants using insecticidal polynucleotides as described herein is about 1 nanomole (nmol) of polynucleotides per plant, for example, from about 0.05 to 1 nmol polynucleotides per plant. Other embodiments for herbaceous plants include useful ranges of about 0.05 to about 100 nmol, or about 0.1 to about 20 nmol, or about 1 nmol to about 10 nmol of polynucleotides per plant. In certain embodiments, about 40 to about 50 nmol of a single-stranded polynucleotide as described herein are applied. In certain embodiments, about 0.5 nmol to about 2 nmol of an insecticidal polynucleotide as described herein is applied. In certain embodiments, a composition containing about 0.5 to about 2.0 milligrams per milliliter, or about 0.14 milligrams per milliliter of an insecticidal polynucleotide (or a single-stranded 21-mer) as described herein is applied. In certain embodiments, a composition of about 0.5 to about 1.5 milligrams per milliliter of an insecticidal polynucleotide as described herein of about 50 to about 200 or more nucleotides is applied. In certain embodiments, about 1 nmol to about 5 nmol of an insecticidal polynucleotide as described herein is applied to a plant. In certain embodiments, a polynucleotide composition as topically applied to the plant comprises at least one polynucleotide as described herein at a concentration of about 0.01 to about 10 milligrams per milliliter, or about 0.05 to about 2 milligrams per milliliter, or about 0.1 to about 2 milligrams per milliliter. Very large plants, trees, or vines can require correspondingly larger amounts of insecticidal polynucleotides. When using long insecticidal polynucleotide molecules that can be processed into multiple oligonucleotides (e. g., multiple oligonucleotides encoded by a single recombinant DNA molecule as disclosed herein), lower concentrations can be used. Non-limiting examples of effective insecticidal polynucleotide treatment regimes include a treatment of between about 0.1 to about 1 nmol of polynucleotide molecule per plant, or between about 1 nmol to about 10 nmol of polynucleotide molecule per plant, or between about 10 nmol to about 100 nmol of polynucleotide molecule per plant.

Methods of Causing Insect Mortality and of Controlling Insect Infestations

Several embodiments relate to a method of causing mortality or stunting in an insect, comprising providing in the diet of an insect at least one insecticidal polynucleotide comprising at least one silencing element essentially identical or essentially complementary to a fragment of a target gene sequence of the insect, wherein the target gene sequence is selected from the group consisting of SEQ ID NOs:1-859, and wherein ingestion of the insecticidal polynucleotide by the insect results in mortality or stunting in the insect. These methods are useful for controlling insect infestations of a plant, for example for prevention or treatment of a flea beetle infestation of a crop plant, particularly commercially important *Brassica* species.

In embodiments, the at least one silencing element comprises a sequence having about 95% to about 100% identity or complementarity with a sequence selected from the group consisting of SEQ ID NOs:860-1718 and 1722-1975 or a fragment thereof. In embodiments, the at least one silencing element comprises 18 or more contiguous nucleotides with a sequence of 100% complementarity with a fragment of the target gene of the insect, wherein the target gene has a DNA sequence selected from the group consisting of SEQ ID NOs:1-859. In embodiments, the at least one silencing element comprises at least one segment of 18 or more contiguous nucleotides of a sequence selected from the group consisting of SEQ ID NOs:860-1718 and 1722-1975 or a fragment thereof. In embodiments, the at least one silencing element comprises a sequence selected from the group consisting of SEQ ID NOs:860-1718 and 1722-1975 or a fragment thereof. In embodiments the at least one silencing element comprises a sequence of about 95% to about 100% identity or complementarity with a sequence selected from the group consisting of SEQ ID NOs:860-1718 and 1722-1975 or a fragment thereof.

In embodiments, the insecticidal polynucleotide is provided in a microbial or plant cell that expresses the insecticidal polynucleotide, or in a microbial fermentation product, or is chemically synthesized. In embodiments, the insecticidal polynucleotide comprises dsRNA. In embodiments, the dsRNA is blunt-ended, or has an overhang at at least one terminus, or comprises at least one stem-loop. In embodiments, the dsRNA is provided by convenient techniques commonly used. In embodiments, the dsRNA is chemically synthesized, produced by expression in a microorganism, produced by expression in a plant cell, or produced by microbial fermentation. In embodiments, the dsRNA is made from naturally occurring ribonucleotides; in other embodiments the dsRNA is chemically modified.

In embodiments, the method is useful for causing mortality or stunting in insects that are pests of commercially important crop plants, such as an insect pest of a *Brassica* species. In embodiments, the insect is a flea beetle. In embodiments, the insect is a species of a genus selected from the group consisting of the genera *Altica, Anthobiodes, Aphthona, Aphthonaltica, Aphthonoides, Apteopeda, Argopistes, Argopus, Arrhenocoela, Batophila, Blepharida, Chaetocnema, Clitea, Crepidodera, Derocrepis, Dibolia, Disonycha, Epitrix, Hermipyxis, Hermaeophaga, Hespera, Hippuriphila, Horaia, Hyphasis, Lipromima, Liprus, Longitarsus, Luperomorpha, Lythraria, Manobia, Mantura, Meishania, Minota, Mniophila, Neicrepidodera, Nonarthra, Novofoudrasia, Ochrosis, Oedionychis, Oglobinia, Omeisphaera, Ophrida, Orestia, Paragopus, Pentamesa, Philopona, Phygasia, Phyllotreta, Podagrica, Podagricomela, Podontia, Pseudodera, Psylliodes, Sangariola, Sinaltica, Sphaeroderma, Systena, Trachyaphthona, Xuthea,* and *Zipangia*. In embodiments, the insect is a species selected from the group consisting of *Altica ambiens* (alder flea beetle), *Altica canadensis* (prairie flea beetle), *Altica chalybaea* (grape flea beetle), *Altica prasina* (poplar flea beetle), *Altica rosae* (rose flea beetle), *Altica sylvia* (blueberry flea beetle), *Altica ulmi* (elm flea beetle), *Chaetocnema pulicaria* (corn flea beele), *Chaetocnema conofinis* (sweet potato flea beetle), *Epitrix cucumeris* (potato flea beetle), *Systena blanda* (palestripped fleabeetle), and *Systena frontalis* (redheaded flea beetle). In embodiments, the insect is a species selected from the group consisting of *Phyllotreta armoraciae* (horseradish flea beetle), *Phyllotreta cruciferae* (canola flea beetle), *Phyllotreta pusilla* (western black flea beetle), *Phyllotreta nemorum* (striped turnip flea beetle), *Phyllotreta atra* (turnip flea beetle), *Phyllotreta robusta* (garden flea beetle), *Phyllotreta striolata* (striped flea beetle), *Phyllotreta undulata, Psylliodes chrysocephala,* and *Psylliodes punctulata* (hop flea beetle).

Embodiments of the method include those in which the insecticidal polynucleotide is designed to silence a target gene in a genus- or species-specific manner, for example, wherein (a) the insect is a *Phyllotreta* species and the target gene has a DNA sequence selected from the group consisting of SEQ ID NOs:1-551; (b) the insect is *Phyllotreta* atra (turnip flea beetle) and the target gene has a DNA sequence selected from the group consisting of SEQ ID NOs:1-296; (c) the insect is *Phyllotreta cruciferae* (canola flea beetle) and the target gene has a DNA sequence selected from the group consisting of SEQ ID NOs:297-532; (d) the insect is *Phyllotreta striolata* (striped flea beetle) and the target gene has a DNA sequence selected from the group consisting of SEQ ID NOs:533-551; (e) the insect is a *Psylliodes* species and the target gene has a DNA sequence selected from the group consisting of SEQ ID NOs:552-859; or (f) the insect is *Psylliodes chrysocephala* and the target gene has a DNA sequence selected from the group consisting of SEQ ID NOs:552-859. Embodiments of the method also include those wherein (a) the insect is a *Phyllotreta* species and the insecticidal polynucleotide comprises a sequence selected from the group consisting of SEQ ID NOs:860-1410 or a fragment thereof; (b) the insect is *Phyllotreta* atra (turnip flea beetle) and the insecticidal polynucleotide comprises a sequence selected from the group consisting of SEQ ID NOs:860-1155 or a fragment thereof; (c) the insect is *Phyllotreta cruciferae* (canola flea beetle) and insecticidal polynucleotide comprises a sequence selected from the group consisting of SEQ ID NOs:1156-1391, 1731-1972, and 1974 or a fragment thereof; (d) the insect is *Phyllotreta striolata* (striped flea beetle) and the insecticidal polynucleotide comprises a sequence selected from the group consisting of SEQ ID NOs:1392-1410, 1973, and 1975 or a fragment thereof; (e) the insect is a *Psylliodes* species and the insecticidal polynucleotide comprises a sequence selected from the group consisting of SEQ ID NOs:1411-1718 or a fragment thereof; or (f) the insect is *Psylliodes chrysocephala* and the insecticidal polynucleotide comprises a sequence selected from the group consisting of SEQ ID NOs:1411-1718 or a fragment thereof.

Embodiments of the method include those wherein at least one insecticidal polynucleotide is provided in a composition comprising the insecticidal polynucleotide, wherein the composition is applied to a surface of the insect or to a surface of a seed or plant in need of protection from infestation by the insect. Embodiments of such compositions include those where the composition is a solid, liquid, powder, suspension, emulsion, spray, encapsulation, microbeads, carrier particulates, film, matrix, soil drench, or seed treatment. In many embodiments, the composition is formulated in a form that is ingested by the insect. In embodiments, the composition further includes one or more components selected from the group consisting of a carrier agent, a surfactant, an organosilicone, a polynucleotide herbicidal molecule, a non-polynucleotide herbicidal molecule, a non-polynucleotide pesticide, a fungicide, a safener, a fertilizer, a micronutrient, an insect attractant, and an insect growth regulator. In embodiments, the composition further comprises at least one pesticidal agent selected from the group consisting of a patatin, a plant lectin, a phytoecdy steroid, a *Bacillus thuringiensis* insecticidal protein, a *Xenorhabdus* insecticidal protein, a *Photorhabdus* insecticidal protein, a *Bacillus laterosporous* insecticidal protein, a *Bacillus sphaericus* insecticidal protein, a bacterium that produces an insecticidal protein, an entomicidal bacterial species, *Lysinibacillus sphaericus* (*Bacillus sphaericus*), *Brevibacillus laterosporus* (*Bacillus laterosporus*), *Chromobacterium* species, *Chromobacterium subtsugae*, *Paenibacillus* species, *Paenibacillus lentimorbus*, and *Paenibacillus popilliae*.

Several embodiments relate to a method for controlling an insect infestation of a plant comprising contacting the plant and/or an insect that infests a plant with a insecticidal polynucleotide, wherein the insecticidal polynucleotide comprises at least one segment of 18 or more contiguous nucleotides with a sequence of about 95% to about 100% (e. g., about 95%, about 96%, about 97%, about 98%, about 99%, or about 100%) complementarity with a fragment of a target gene of the insect selected from the group consisting of actin, Act5C, arginine kinase, COPI (coatomer subunit) alpha, COPI (coatomer subunit) beta, COPI (coatomer subunit) betaPrime, COPI (coatomer subunit) delta, COPI (coatomer subunit) epsilon, COPI (coatomer subunit) gamma, COPI (coatomer subunit) zeta, RpL07, RpL19, RpL3, RpL40, RpL13, RpL14, RpS21, RpS4, RpS14, Rpn2, Rpn3, Rpn7, Rpt6, Rpn8, Rpn9, Rpn6-PB-like protein, Sar1, sec6, sec23, sec23A, shrb (snf7), Tubulin gamma chain, ProsAlpha2, ProsBeta5, Proteasome alpha 2, Proteasome beta 5, VATPase E, VATPase A, VATPase B, VATPase D, Vps2, Vps4, Vps16A, Vps20, Vps24, Vps27, Vps28, Vha26 (V-ATPase A), Vha68-2 (V-ATPase D/E), 40S ribosomal protein S14, and 60S ribosomal protein L13. In some embodiments, the insecticidal polynucleotide comprises at least one segment of 18 or more contiguous nucleotides with a sequence of about 95% to about 100% complementarity with a fragment of a DNA sequence selected from the group consisting of SEQ ID NOs:1-859. In some embodiments, the insecticidal polynucleotide comprises at least one segment of 21 contiguous nucleotides with a sequence of 100% complementarity with a fragment of a DNA sequence selected from the group consisting of SEQ ID NOs:1-859. In this context "controlling" includes inducement of a physiological or behavioural change in an insect (adult or larvae or nymphs) such as, but not limited to, growth stunting, increased mortality, decrease in reproductive capacity, decrease in or cessation of feeding behavior or movement, or decrease in or cessation of metamorphosis stage development. In some embodiments, the insecticidal polynucleotide comprises a sequence selected from the group consisting of SEQ ID NOs:860-1155 or a fragment thereof, or the complement thereof.

In various embodiments, the insect is a flea beetle, e. g., a species of a genus selected from the group consisting of the genera *Altica, Anthobiodes, Aphthona, Aphthonaltica, Aphthonoides, Apteopeda, Argopistes, Argopus, Arrhenocoela, Batophila, Blepharida, Chaetocnema, Clitea, Crepidodera, Derocrepis, Dibolia, Disonycha, Epitrix, Hermipyxis, Hermaeophaga, Hespera, Hippuriphila, Horaia, Hyphasis, Lipromima, Liprus, Longitarsus, Luperomorpha, Lythraria, Manobia, Mantura, Meishania, Minota, Mniophila, Neicrepidodera, Nonartha, Novofoudrasia, Ochrosis, Oedionychis, Oglobinia, Omeisphaera, Ophrida, Orestia, Paragopus, Pentamesa, Philopona, Phygasia, Phyllotreta, Podagrica, Podagricomela, Podontia, Pseudodera, Psylliodes, Sangariola, Sinaltica, Sphaeroderma, Systena, Trachyaphthona, Xuthea*, and *Zipangia*. In some embodiments, the insect is selected from the group consisting of *Altica ambiens* (alder flea beetle), *Altica canadensis* (prairie flea beetle), *Altica chalybaea* (grape flea beetle), *Altica prasina* (poplar flea beetle), *Altica rosae* (rose flea beetle), *Altica sylvia* (blueberry flea beetle), *Altica ulmi* (elm flea beetle), *Chaetocnema pulicaria* (corn flea beele), *Chaetocnema conofinis* (sweet potato flea beetle), *Epitrix cucumeris* (potato flea beetle), *Systena blanda* (palestripped fleabeetle), and *Systena frontalis* (redheaded flea beetle). In some embodiments, the insect is selected from the group consisting of *Phyllotreta armoraciae* (horseradish flea beetle), *Phyllotreta cruciferae* (canola flea beetle), *Phyllotreta pusilla* (western black flea beetle), *Phyllotreta nemorum* (striped turnip flea beetle), *Phyllotreta atra* (turnip flea beetle), *Phyllotreta robusta* (garden flea beetle), *Phyllotreta striolata* (striped flea beetle), *Phyllotreta undulata*, *Psylliodes chrysocephala*, and *Psylliodes punctulata* (hop flea beetle).

The plant can be any plant that is subject to infestation by an insect that can be controlled by the insecticidal polynucleotides disclosed herein. Plants of particular interest include commercially important plants, including row crop plants, vegetables, and fruits, and other plants of agricultural or decorative use. Examples of suitable plants are provided under the heading "Plants". The method is especially useful for controlling an insect infestation of an ornamental plant or a crop plant. Various embodiments of the method include those wherein the plant is a plant in the family Brassicaceae, including a *Brassica* species selected from the group consisting of *B. napus, B. juncea, B. carinata, B. rapa, B. oleracea, B. rupestris, B. septiceps, B. nigra, B. narinosa, B. perviridus, B. tournefortii*, and *B. fructiculosa*. In other embodiments, the plant is selected from the group consisting of *Glycine max, Linum usitatissimum, Zea mays, Carthamus tinctorius, Helianthus annuus, Nicohana tabacum, Arabidopsis thaliana, Betholettia excelsa, Ricinus communis, Cocus nucifera, Coriandrum sativum, Gossypium* spp., *Arachis hypogaea, Simmondsia chinensis, Solanum tuberosum, Elaeis guineensis, Olea europaea, Oryza sativa, Cucurbita maxim, Hordeum vulgare*, and *Triticum aestivum*.

Methods include those developed for specific flea beetle pests for a given plant, e. g., wherein the plant is a potato plant and the insect is *Epitrix cucumeris* (potato flea beetle). In some embodiments, specific target genes are identified as targets for RNAi-mediated control in a given insect species. Various embodiments of the method include those wherein (a) the insect is *Phyllotreta atra* (turnip flea beetle) and the target gene has a DNA sequence selected from the group consisting of SEQ ID NOs:1-296; (b) the insect is *Phyllotreta cruciferae* (canola flea beetle) and the target gene has a DNA sequence selected from the group consisting of SEQ ID NOs:297-532; (c) the insect is *Phyllotreta striolata* (striped flea beetle) and the target gene has a DNA sequence selected from the group consisting of SEQ ID NOs:533-551; or (d) the insect is *Psylliodes chrysocephala* and the target gene has a DNA sequence selected from the group consisting of SEQ ID NOs:552-859.

In some embodiments, specific insecticidal polynucleotides are developed for specific target genes in a given insect species. Embodiments of the method include those wherein (a) the insect is *Phyllotreta atra* (turnip flea beetle) and the insecticidal polynucleotide comprises at least one sequence selected from the group consisting of SEQ ID NOs:860-1155 or a fragment thereof; (b) the insect is *Phyllotreta cruciferae* (canola flea beetle) and the insecticidal polynucleotide comprises at least one sequence selected from the group consisting of SEQ ID NOs:1156-1391, 1731-1972, and 1974 or a fragment thereof; (c) the insect is *Phyllotreta striolata* (striped flea beetle) and the insecticidal polynucleotide comprises at least one sequence selected from the group consisting of SEQ ID NOs:1392-1410, 1973, and 1975 or a fragment thereof; or (d) the insect is *Psylliodes chrysocephala* and the insecticidal polynucleotide comprises at least one sequence selected from the group consisting of SEQ ID NOs:1411-1718 or a fragment thereof.

The method includes contacting an insect, such as a flea beetle, with an insecticidal polynucleotide. Embodiments include contacting via oral delivery to the insect, or non-oral delivery to the insect, or a combination of oral and non-oral delivery to the insect. Embodiments include contacting insects in the adult stage, or in larval stages, or in the egg stage. In some embodiments, contacting results in mortality (death) or stunting (growth stunting or decrease in or cessation of metamorphosis stage development) of the insect, thereby preventing or treating infestation of the plant by the insect. In some embodiments, contacting results in inducement of a physiological or behavioural change in an insect (adult or larvae or nymphs) that results in a decreased ability of the insect to infest or damage a plant, for example, a decrease in reproductive capacity, or a decrease in or cessation of feeding behavior or movement.

In some embodiments of the method, the contacting comprises application of a composition comprising one or more insecticidal polynucleotide to a surface of the insect or to a surface of the plant infested by the insect. The composition can comprise or be in the form of a solid, liquid, powder, suspension, emulsion, spray, encapsulation, microbeads, carrier particulates, film, matrix, soil drench, or seed treatment. In some embodiments, the contacting comprises providing the insecticidal polynucleotide in a composition that further comprises one or more components selected from the group consisting of a carrier agent, a surfactant, an organosilicone, a polynucleotide herbicidal molecule, a non-polynucleotide herbicidal molecule, a non-polynucleotide pesticide, a fungicide, a safener, an insect attractant, and an insect growth regulator. In some embodiments, the contacting comprises providing the one or more insecticidal polynucleotides in a composition that further comprises at least one pesticidal agent selected from the group consisting of a patatin, a plant lectin, a phytoecdy steroid, a *Bacillus thuringiensis* insecticidal protein, a *Xenorhabdus* insecticidal protein, a *Photorhabdus* insecticidal protein, a *Bacillus laterosporous* insecticidal protein, a *Bacillus sphaericus* insecticidal protein, a bacterium that produces an insecticidal protein, an entomicidal bacterial species, *Lysinibacillus sphaericus* (*Bacillus sphaericus*), *Brevibacillus laterosporus* (*Bacillus laterosporus*), *Chromobacterium* species, *Chromobacterium subtsugae, Paenibacillus* species, *Paenibacillus lentimorbus*, and *Paenibacillus popilliae*.

In some embodiments of the method, the contacting comprises providing one or more insecticidal polynucleotides in a composition that is ingested by the insect, such as in a liquid, emulsion, or powder applied to a plant on which the insect feeds, or in the form of bait. Such compositions can further comprise one or more components selected from the group consisting of a carrier agent, a surfactant, an organosilicone, a polynucleotide herbicidal molecule, a non-polynucleotide herbicidal molecule, a non-polynucleotide pesticide, a fungicide, a safener, an insect attractant, and an insect growth regulator. Such compositions can further comprise at least one pesticidal agent selected from the group consisting of a patatin, a plant lectin, a phytoecdysteroid, a *Bacillus thuringiensis* insecticidal protein, a *Xenorhabdus* insecticidal protein, a *Photorhabdus* insecticidal protein, a *Bacillus* laterosporous insecticidal protein, a *Bacillus sphaericus* insecticidal protein, a bacterium that produces an insecticidal protein, an entomicidal bacterial species, *Lysinibacillus sphaericus* (*Bacillus sphaericus*), *Brevibacillus laterosporus* (*Bacillus laterosporus*), *Chromobacterium* species, *Chromobacterium subtsugae, Paenibacillus* species, *Paenibacillus lentimorbus*, and *Paenibacillus popilliae*. In embodiments, the combination of the insecticidal polynucleotide and the non-polynucleotide pesticidal agent provides a level of insect control that is greater than the sum of the effects of the insecticidal polynucleotide and the non-polynucleotide pesticidal agent components if tested separately.

Insecticidal Compositions

Several embodiments relate to an insecticidal composition comprising an insecticidally effective amount of an insecticidal polynucleotide, such as a ssRNA, dsRNA, ssDNA, dsDNA or hybrid RNA/DNA molecule, wherein the insecticidal polynucleotide comprises at least 18 or more contiguous nucleotides with a sequence of about 95% to about 100% (e. g., about 95%, about 96%, about 97%, about 98%, about 99%, or about 100%) complementarity with a fragment of an insect target gene selected from the group consisting of actin, Act5C, arginine kinase, COPI (coatomer subunit) alpha, COPI (coatomer subunit) beta, COPI (coatomer subunit) betaPrime, COPI (coatomer subunit) delta, COPI (coatomer subunit) epsilon, COPI (coatomer subunit) gamma, COPI (coatomer subunit) zeta, RpL07, RpL19, RpL3, RpL40, RpL13, RpL14, RpS21, RpS4, RpS14, Rpn2, Rpn3, Rpn7, Rpt6, Rpn8, Rpn9, Rpn6-PB-like protein, Sar1, sec6, sec23, sec23A, shrb (snf7), Tubulin gamma chain, ProsAlpha2, ProsBeta5, Proteasome alpha 2, Proteasome beta 5, VATPase E, VATPase A, VATPase B, VATPase D, Vps2, Vps4, Vps16A, Vps20, Vps24, Vps27, Vps28, Vha26 (V-ATPase A), Vha68-2 (V-ATPase D/E), 40S ribosomal protein S14, and 60S ribosomal protein L13. In some embodiments the insecticidal polynucleotide comprises at least 18 or more contiguous nucleotides having about 95% to about 100% complementarity with a fragment of a DNA sequence selected from the group consisting of SEQ ID NOs:1-859. In some embodiments the insecticidal polynucleotide comprises at least 21 contiguous nucleotides having 100% complementarity with a fragment of a DNA sequence selected from the group consisting of SEQ ID NOs:1-859. In embodiments, the insecticidal polynucleotide comprises a sequence selected from the group consisting of SEQ ID NOs:860-1718 and 1722-1975 or a fragment thereof.

In various embodiments of the insecticidal composition, the insect is a flea beetle, e. g., a species of a genus selected from the group consisting of the genera *Altica, Anthobiodes, Aphthona, Aphthonaltica, Aphthonoides, Apteopeda, Argopistes, Argopus, Arrhenocoela, Batophila, Blepharida, Chaetocnema, Clitea, Crepidodera, Derocrepis, Dibolia, Disonycha, Epitrix, Hermipyxis, Hermaeophaga, Hespera, Hippuriphila, Horaia, Hyphasis, Lipromima, Liprus, Longitarsus, Luperomorpha, Lythraria, Manobia, Mantura, Meishania, Minota, Mniophila, Neicrepidodera, Nonarthra, Novofoudrasia, Ochrosis, Oedionychis, Oglobinia, Omeisphaera, Ophrida, Orestia, Paragopus, Pentamesa, Philopona, Phygasia, Phyllotreta, Podagrica, Podagricomela, Podonfia, Pseudodera, Psylliodes, Sangariola, Sinaltica, Sphaeroderma, Systena, Trachyaphthona, Xuthea,* and *Zipangia*. In some embodiments, the insect is selected from the group consisting of *Altica ambiens* (alder flea beetle), *Altica canadensis* (prairie flea beetle), *Altica chalybaea* (grape flea beetle), *Altica prasina* (poplar flea beetle), *Altica rosae* (rose flea beetle), *Altica sylvia* (blueberry flea beetle), *Altica ulmi* (elm flea beetle), *Chaetocnema pulicaria* (corn flea beele), *Chaetocnema conofinis* (sweet potato flea beetle), *Epitrix cucumeris* (potato flea beetle), *Systena blanda* (palestripped fleabeetle), and *Systena frontalis* (red-headed flea beetle). In some embodiments, the insect is selected from the group consisting of *Phyllotreta armoraciae* (horseradish flea beetle), *Phyllotreta cruciferae* (canola flea beetle), *Phyllotreta pusilla* (western black flea beetle), *Phyllotreta nemorum* (striped turnip flea beetle), *Phyllotreta atra* (turnip flea beetle), *Phyllotreta robusta* (garden flea beetle), *Phyllotreta striolata* (striped flea beetle), *Phyllotreta undulata, Psylliodes chrysocephala*, and *Psylliodes punctulata* (hop flea beetle).

The insecticidal composition is useful for treating a plant or area in the vicinity of a plant to provide protection or treatment from insects, especially flea beetles. A related aspect is a plant treated with an insecticidal composition as described herein, or a seed of the treated plant, wherein the plant exhibits improved resistance to the insect (e. g., improved resistance to flea beetles). In some embodiments, the plant exhibiting improved resistance to the insect is characterized by improved yield, when compared to a plant not treated with the insecticidal composition. In an embodiment, yield (oilseed biomass or oil content) in canola or oilseed rape plants is improved by application of an insecticidally effective amount of a insecticidal polynucleotide targetting one or more genes identified from *Phyllotreta cruciferae* (canola flea beetle); in particular embodiments, the target gene has a DNA sequence selected from the group consisting of SEQ ID NOs:297-532. The plant can be any plant that is subject to infestation by an insect that can be controlled by the insecticidal composition. Plants of particular interest include commercially important plants, including row crop plants, vegetables, and fruits, and other plants of agricultural or decorative use. Examples of suitable plants are provided under the heading "Plants". The method is especially useful for controlling an insect infestation of an ornamental plant or a crop plant. Various embodiments include those wherein the plant is a plant in the family Brassicaceae, including a *Brassica* species selected from the group consisting of *B. napus, B. juncea, B. carinata, B. rapa, B. oleracea, B. rupestris, B. sepficeps, B. nigra, B. narinosa, B. perviridus, B. tournefortii*, and *B. fructiculosa*. In other embodiments, the plant is selected from the group consisting of *Glycine max, Linum usitatissimum, Zea mays, Carthamus tinctorius, Helianthus annuus, Nicotiana tabacum, Arabidopsis thaliana, Betholettia excelsa, Ricinus communis, Cocus nucifera, Coriandrum sativum, Gossypium* spp., *Arachis hypogaea, Simmondsia chinensis, Solanum tuberosum, Elaeis guineensis, Olea europaea, Oryza sativa, Cucurbita maxim, Hordeum vulgare*, and *Trificum aestivum*.

In some embodiments, the insecticidal composition is developed for specific flea beetle pests for a given plant, e. g., where the plant is a potato plant and the insect is *Epitrix cucumeris* (potato flea beetle). In some embodiments, the insecticidal composition is developed for specific target genes in a given insect species. Specific embodiments of the insecticidal composition include those wherein (a) the insect is *Phyllotreta* atra (turnip flea beetle) and the target gene has a DNA sequence selected from the group consisting of SEQ ID NOs:1-296; (b) the insect is *Phyllotreta cruciferae* (canola flea beetle) and the target gene has a DNA sequence selected from the group consisting of SEQ ID NOs:297-532; (c) the insect is *Phyllotreta striolata* (striped flea beetle) and the target gene has a DNA sequence selected from the group consisting of SEQ ID NOs:533-551; or (d) the insect is *Psylliodes chrysocephala* and the target gene has a DNA sequence selected from the group consisting of SEQ ID NOs:552-859.

In some embodiments the insecticidal polynucleotide molecule of use in this method is provided as an isolated insecticidal polynucleotide molecule (not part of an expression construct, e. g., lacking additional elements such as a promoter or terminator sequences). Such insecticidal polynucleotide molecules can be relatively short, such as single- or double-stranded RNA, DNA or hybrid RNA/DNA molecules of between about 18 to about 300 or between about 50 to about 500 nucleotides (for single-stranded polynucleotides) or between about 18 to about 300 or between about 50 to about 500 base-pairs (for double-stranded polynucleotides). In embodiments the polynucleotide is a dsRNA comprising a sequence selected from the group consisting of SEQ ID NOs:860-1718 and 1722-1975 or a fragment thereof.

In some embodiments, the insecticidal composition is in a form selected from the group consisting of a solid, liquid, powder, suspension, emulsion, spray, encapsulation, microbeads, carrier particulates, film, matrix, soil drench, insect diet or insect bait, and seed treatment. In some embodiments, the insecticidal composition is provided in a form that is ingested by the insect, such as in a liquid, emulsion, or powder applied to a plant on which the insect feeds, or in the form of bait. The insecticidal compositions can further comprise one or more components selected from the group consisting of a carrier agent, a surfactant, an organosilicone, a polynucleotide herbicidal molecule, a non-polynucleotide herbicidal molecule, a non-polynucleotide pesticide, a fungicide, a safener, an insect attractant, and an insect growth regulator. The insecticidal compositions can further comprise at least one pesticidal agent selected from the group consisting of a patatin, a plant lectin, a phytoecdy steroid, a *Bacillus thuringiensis* insecticidal protein, a *Xenorhabdus* insecticidal protein, a *Photorhabdus* insecticidal protein, a *Bacillus* laterosporous insecticidal protein, a *Bacillus sphaericus* insecticidal protein, a bacterium that produces an insecticidal protein, an entomicidal bacterial species, *Lysinibacillus sphaericus (Bacillus sphaericus), Brevibacillus laterosporus (Bacillus laterosporus), Chromobacterium* species, *Chromobacterium subtsugae, Paenibacillus* species, *Paenibacillus lentimorbus*, and *Paenibacillus popilliae*. In some embodiments, the combination of the insecticidal polynucleotide molecule and the non-polynucleotide pesticidal agent provides a level of insect control that is greater than the sum of the effects of the insecticidal polynucleotide molecule and the non-polynucleotide pesticidal agent components if tested separately.

Embodiments of the compositions optionally comprise the appropriate stickers and wetters required for efficient foliar coverage as well as UV protectants to protect insecticidal polynucleotides, such as dsRNAs, from UV damage. Such additives are commonly used in the bioinsecticide industry and are known to those skilled in the art. Compositions for soil application can comprise granular formulations that serve as bait for insect larvae. Embodiments include a carrier agent, a surfactant, an organosilicone, a polynucleotide herbicidal molecule, a non-polynucleotide herbicidal molecule, a non-polynucleotide pesticide, a fungicide, a safener, an insect attractant, and an insect growth regulator.

Embodiments of compositions may comprise a "transfer agent", an agent that, when combined with a composition comprising an insecticidal polynucleotide as disclosed herein that is topically applied to the surface of an organism, enables the polynucleotide to enter the cells of that organism. Such transfer agents can be incorporated as part of the composition comprising a insecticidal polynucleotide as disclosed herein, or can be applied prior to, contemporaneously with, or following application of the composition comprising an insecticidal polynucleotide as described herein. In some embodiments, a transfer agent is an agent that improves the uptake of an insecticidal polynucleotide by an insect. In some embodiments, a transfer agent is an agent that conditions the surface of plant tissue, e. g., seeds, leaves, stems, roots, flowers, or fruits, to permeation by an insecticidal polynucleotide into plant cells. In some embodiments, the transfer agent enables a pathway for a polynucleotide through cuticle wax barriers, stomata, and/or cell wall or membrane barriers into plant cells.

Suitable transfer agents include agents that increase permeability of the exterior of the organism or that increase permeability of cells of the organism to polynucleotides. Suitable transfer agents include a chemical agent, or a physical agent, or combinations thereof. Chemical agents for conditioning or transfer include (a) surfactants, (b) an organic solvent or an aqueous solution or aqueous mixtures of organic solvents, (c) oxidizing agents, (d) acids, (e) bases, (f) oils, (g) enzymes, or combinations thereof. In some embodiments, application of an insecticidal polynucleotide and a transfer agent optionally includes one or more of an incubation step, a neutralization step (e. g., to neutralize an acid, base, or oxidizing agent, or to inactivate an enzyme), a rinsing step, or combinations thereof. Suitable transfer agents can be in the form of an emulsion, a reverse emulsion, a liposome, or other micellar-like composition, or can cause the polynucleotide composition to take the form of an emulsion, a reverse emulsion, a liposome, or other micellar-like composition. Embodiments of transfer agents include counter-ions or other molecules that are known to associate with nucleic acid molecules, e. g., cationic lipids, inorganic ammonium ions, alkyl ammonium ions, lithium ions, polyamines such as spermine, spermidine, or putrescine, and other cations. Embodiments of transfer agents include organic solvents such as DMSO, DMF, pyridine, N-pyrrolidine, hexamethylphosphoramide, acetonitrile, dioxane, polypropylene glycol, or other solvents miscible with water or that dissolve phosphonucleotides in non-aqueous systems (such as is used in synthetic reactions). Embodiments of transfer agents include naturally derived or synthetic oils with or without surfactants or emulsifiers, e. g., plant-sourced oils, crop oils (such as those listed in the 9$^{th}$ Compendium of Herbicide Adjuvants, publicly available on-line at herbicide.adjuvants.com), paraffinic oils, polyol fatty acid esters, or oils with short-chain molecules modified with amides or polyamines such as polyethyleneimine or N-pyrrolidine.

Embodiments of transfer agents include organosilicone preparations. For example, a suitable transfer agent is an organosilicone preparation that is commercially available as SILWET L-77® brand surfactant having CAS Number 27306-78-1 and EPA Number: CAL.REG.NO. 5905-50073-AA, and currently available from Momentive Performance Materials, Albany, N.Y. In embodiments where a SILWET L-77® brand surfactant organosilicone preparation is used as transfer agent in the form of a spray treatment (applied prior to, contemporaneously with, or following application of the composition comprising an insecticidal polynucleotide as disclosed herein) of plant leaves or other plant surfaces, freshly made concentrations in the range of about 0.015 to about 2 percent by weight (wt percent) (e. g., about 0.01, 0.015, 0.02, 0.025, 0.03, 0.035, 0.04, 0.045, 0.05, 0.055, 0.06, 0.065, 0.07, 0.075, 0.08, 0.085, 0.09, 0.095, 0.1, 0.2, 0.3, 0.4, 0.5, 0.6, 0.7, 0.8, 0.9, 1.0, 1.1, 1.2, 1.3, 1.4, 1.5, 1.6, 1.7, 1.8, 1.9, 2.0, 2.1, 2.2, 2.3, 2.5 wt percent) are efficacious in preparing a leaf or other plant surface for transfer of a polynucleotide as disclosed herein into plant cells from a topical application on the surface. One embodiment includes a composition that comprises a polynucleotide and a transfer agent including an organosilicone preparation such as Silwet L-77 in the range of about 0.015 to about 2 percent by weight (wt percent) (e. g., about 0.01, 0.015, 0.02, 0.025, 0.03, 0.035, 0.04, 0.045, 0.05, 0.055, 0.06, 0.065, 0.07, 0.075, 0.08, 0.085, 0.09, 0.095, 0.1, 0.2, 0.3, 0.4, 0.5, 0.6, 0.7, 0.8, 0.9, 1.0, 1.1, 1.2, 1.3, 1.4, 1.5, 1.6, 1.7, 1.8, 1.9, 2.0, 2.1, 2.2, 2.3, 2.5 wt percent). One embodiment includes a composition that comprises a polynucleotide and a transfer agent including SILWET L-77® brand surfactant in the range of about 0.3 to about 1 percent by weight (wt percent) or about 0.5 to about 1%, by weight (wt percent).

Organosilicone compounds useful as transfer agents for use in compositions and methods disclosed herein include, but are not limited to, compounds that include: (a) a trisiloxane head group that is covalently linked to, (b) an alkyl linker including, but not limited to, an n-propyl linker, that is covalently linked to, (c) a polyglycol chain, that is covalently linked to, (d) a terminal group. Trisiloxane head groups of such organosilicone compounds include, but are not limited to, heptamethyltrisiloxane. Alkyl linkers can include, but are not limited to, an n-propyl linker. Polyglycol chains include, but are not limited to, polyethylene glycol or polypropylene glycol. Polyglycol chains can include a mixture that provides an average chain length "n" of about "7.5". In certain embodiments, the average chain length "n" can vary from about 5 to about 14. Terminal groups can include, but are not limited to, alkyl groups such as a methyl group. Organosilicone compounds useful as transfer agents for use in compositions and methods disclosed herein include, but are not limited to, trisiloxane ethoxylate surfactants or polyalkylene oxide modified heptamethyl trisiloxane. An example of a transfer agent for use in compositions and methods disclosed herein is Compound I:

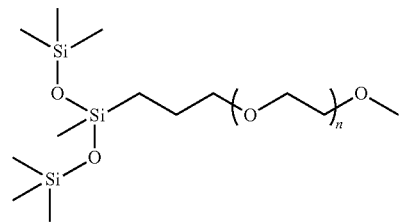

(Compound I: polyalkyleneoxide heptamethyltrisiloxane, average n=7.5).

Organosilicone compounds useful as transfer agents for use in compositions and methods disclosed herein are used, e. g., as freshly made concentrations in the range of about 0.015 to about 2 percent by weight (wt percent) (e. g., about 0.01, 0.015, 0.02, 0.025, 0.03, 0.035, 0.04, 0.045, 0.05, 0.055, 0.06, 0.065, 0.07, 0.075, 0.08, 0.085, 0.09, 0.095, 0.1, 0.2, 0.3, 0.4, 0.5, 0.6, 0.7, 0.8, 0.9, 1.0, 1.1, 1.2, 1.3, 1.4, 1.5, 1.6, 1.7, 1.8, 1.9, 2.0, 2.1, 2.2, 2.3, 2.5 wt percent).

Embodiments of transfer agents include one or more salts such as ammonium chloride, tetrabutylphosphonium bromide, and ammonium sulfate, provided in or used with a composition comprising an insecticidal polynucleotide disclosed herein. In some embodiments, ammonium chloride, tetrabutylphosphonium bromide, and/or ammonium sulfate are used at a concentration of about 0.5% to about 5% (w/v), or about 1% to about 3% (w/v), or about 2% (w/v). In certain embodiments, the composition comprising an insecticidal polynucleotide comprises an ammonium salt at a concentration greater or equal to 300 millimolar. In certain embodiments, the composition comprising an insecticidal polynucleotide comprises an organosilicone transfer agent in a concentration of about 0.015 to about 2 percent by weight (wt percent) as well as ammonium sulfate at concentrations from about 80 to about 1200 millimolar or about 150 millimolar to about 600 millimolar.

Embodiments of transfer agents include a phosphate salt. Phosphate salts useful in a composition comprising an insecticidal polynucleotide include, but are not limited to, calcium, magnesium, potassium, or sodium phosphate salts. In certain embodiments, the composition comprising an insecticidal polynucleotide includes a phosphate salt at a concentration of at least about 5 millimolar, at least about 10 millimolar, or at least about 20 millimolar. In certain embodiments, the composition comprising an insecticidal polynucleotide includes a phosphate salt in a range of about 1 millimolar to about 25 millimolar or in a range of about 5 millimolar to about 25 millimolar. In certain embodiments, the composition comprising an insecticidal polynucleotide includes sodium phosphate at a concentration of at least about 5 millimolar, at least about 10 millimolar, or at least about 20 millimolar. In certain embodiments, the composition comprising an insecticidal polynucleotide includes sodium phosphate at a concentration of about 5 millimolar, about 10 millimolar, or about 20 millimolar. In certain embodiments, the composition comprising an insecticidal polynucleotide includes a sodium phosphate salt in a range of about 1 millimolar to about 25 millimolar or in a range of about 5 millimolar to about 25 millimolar. In certain embodiments, the composition comprising an insecticidal polynucleotide includes a sodium phosphate salt in a range of about 10 millimolar to about 160 millimolar or in a range of about 20 millimolar to about 40 millimolar. In certain embodiments, the composition comprising an insecticidal polynucleotide includes a sodium phosphate buffer at a pH of about 6.8.

Embodiments of transfer agents include surfactants and/or effective molecules contained therein. Surfactants and/or effective molecules contained therein include, but are not limited to, sodium or lithium salts of fatty acids (such as tallow or tallowamines or phospholipids) and organosilicone surfactants. In certain embodiments, the composition comprising an insecticidal polynucleotide is formulated with counter-ions or other molecules that are known to associate with nucleic acid molecules. Non-limiting examples include, tetraalkyl ammonium ions, trialkyl ammonium ions, sulfonium ions, lithium ions, and polyamines such as spermine, spermidine, or putrescine. In certain embodiments, the composition comprising an insecticidal polynucleotide is formulated with a non-polynucleotide herbicide e. g., glyphosate, auxin-like benzoic acid herbicides including dicamba, chloramben, and TBA, glufosinate, auxin-like herbicides including phenoxy carboxylic acid herbicide, pyridine carboxylic acid herbicide, quinoline carboxylic acid herbicide, pyrimidine carboxylic acid herbicide, and benazolin-ethyl herbicide, sulfonylureas, imidazolinones, bromoxynil, delapon, cyclohezanedione, protoporphyrinogen oxidase inhibitors, and 4-hydroxyphenyl-pyruvate-dioxygenase inhibiting herbicides. In certain embodiments, the composition comprising an insecticidal polynucleotide is formulated with a non-polynucleotide pesticide, e. g., a patatin, a plant lectin, a phytoecdy steroid, a *Bacillus thuringiensis* insecticidal protein, a *Xenorhabdus* insecticidal protein, a *Photorhabdus* insecticidal protein, a *Bacillus laterosporous* insecticidal protein, and a *Bacillus sphaericus* insecticidal protein.

Methods of Providing Plants with Improved Insect Resistance

Several embodiments relate to a method of providing a plant having improved resistance to an insect, comprising expressing in the plant a recombinant DNA construct, wherein the recombinant DNA construct comprises DNA encoding an insecticidal polynucleotide comprising a sequence of at least 21 contiguous nucleotides that are essentially identical or essentially complementary to a fragment of at least one insect target gene selected from the group consisting of actin, Act5C, arginine kinase, COPI (coatomer subunit) alpha, COPI (coatomer subunit) beta, COPI (coatomer subunit) betaPrime, COPI (coatomer subunit) delta, COPI (coatomer subunit) epsilon, COPI (coatomer subunit) gamma, COPI (coatomer subunit) zeta, RpL07, RpL19, RpL3, RpL40, RpL13, RpL14, RpS21, RpS4, RpS14, Rpn2, Rpn3, Rpn7, Rpt6, Rpn8, Rpn9, Rpn6-PB-like protein, Sar1, sec6, sec23, sec23A, shrb (snf7), Tubulin gamma chain, ProsAlpha2, ProsBeta5, Proteasome alpha 2, Proteasome beta 5, VATPase E, VATPase A, VATPase B, VATPase D, Vps2, Vps4, Vps16A, Vps20, Vps24, Vps27, Vps28, Vha26 (V-ATPase A), Vha68-2 (V-ATPase D/E), 40S ribosomal protein S14, and 60S ribosomal protein L13. In some embodiments, the DNA construct comprises DNA encoding an insecticidal polynucleotide comprising a sequence essentially identical or essentially complementary to a fragment of a DNA sequence selected from the group consisting of SEQ ID NOs:1-859. Several embodiments relate to a plant produced by such method. In some embodiments, the DNA construct comprises DNA encoding an insecticidal polynucleotide having about 95% to about 100% (e. g., about 95%, about 96%, about 97%, about 98%, about 99%, or about 100%) identity or complementarity with at least 21 contiguous nucleotides of a sequence selected from the group consisting of SEQ ID NOs:860-1718 and 1722-1975 or a fragment thereof.

In some embodiments, the recombinant DNA construct further comprises a heterologous promoter operably linked to the DNA encoding an insecticidal polynucleotide, wherein the heterologous promoter is functional in a plant cell. "Heterologous" refers to nucleic acid sequences that are not usually operably linked in a native or naturally occurring genome; by "heterologous promoter" is meant that the promoter is not natively operably linked with the DNA encoding an insecticidal polynucleotide. Promoters functional in a plant cell include those listed under the heading "Promoters".

In some embodiments, the recombinant DNA construct is expressed in the plant by means of transgenic expression or transient expression. In some embodiments, the method further comprises expression in the plant of at least one pesticidal agent selected from the group consisting of a patatin, a plant lectin, a phytoecdysteroid, a *Bacillus thuringiensis* insecticidal protein, a *Xenorhabdus* insecticidal protein, a *Photorhabdus* insecticidal protein, a *Bacillus laterosporous* insecticidal protein, a *Bacillus sphaericus* insecticidal protein, a bacterium that produces an insecticidal protein, an entomicidal bacterial species, *Lysinibacillus sphaericus* (*Bacillus sphaericus*), *Brevibacillus laterosporus* (*Bacillus laterosporus*), *Chromobacterium* species, *Chromobacterium subtsugae*, *Paenibacillus* species, *Paeni-*

*bacillus lentimorbus*, and *Paenibacillus popilliae*. The pesticidal agent can be expressed from the same recombinant DNA construct that comprises the DNA encoding an insecticidal polynucleotide, or from a different recombinant DNA construct.

A related aspect is a plant having improved resistance to an insect (e. g., improved resistance to flea beetles), or the seed of such a plant, wherein the plant is provided by the method comprising expressing in the plant a recombinant DNA construct, wherein the recombinant DNA construct comprises DNA encoding an insecticidal polynucleotide having a sequence essentially identical or essentially complementary to a fragment of at least one target gene of the insect, wherein the target gene is selected from the group consisting of actin, Act5C, arginine kinase, COPI (coatomer subunit) alpha, COPI (coatomer subunit) beta, COPI (coatomer subunit) betaPrime, COPI (coatomer subunit) delta, COPI (coatomer subunit) epsilon, COPI (coatomer subunit) gamma, COPI (coatomer subunit) zeta, RpL07, RpL19, RpL3, RpL40, RpL13, RpL14, RpS21, RpS4, RpS14, Rpn2, Rpn3, Rpn7, Rpt6, Rpn8, Rpn9, Rpn6-PB-like protein, Sar1, sec6, sec23, sec23A, shrb (snf7), Tubulin gamma chain, ProsAlpha2, ProsBeta5, Proteasome alpha 2, Proteasome beta 5, VATPase E, VATPase A, VATPase B, VATPase D, Vps2, Vps4, Vps16A, Vps20, Vps24, Vps27, Vps28, Vha26 (V-ATPase A), Vha68-2 (V-ATPase D/E), 40S ribosomal protein S14, and 60S ribosomal protein L13. In some embodiments, the recombinant DNA construct comprises DNA encoding an insecticidal polynucleotide comprising a sequence essentially identical or essentially complementary to a fragment of a DNA sequence selected from the group consisting of SEQ ID NOs:1-859. In some embodiments, the plant exhibiting improved resistance to the insect is characterized by improved yield, when compared to a plant not expressing the recombinant DNA construct. In an embodiment, yield (oilseed biomass or oil content) in canola or oilseed rape plants is improved by expressing in the canola or oilseed rape plants an insecticidal polynucleotide, such as a dsRNA molecule, targetting one or more genes of *Phyllotreta cruciferae* (canola flea beetle), e. g., wherein the target gene has a DNA sequence selected from the group consisting of SEQ ID NOs:297-532. Several embodiments relate to fruit, seed, or propagatable parts of the plant provided by this method and exhibiting improved resistance to the insect. The plant can be any plant that is subject to infestation by an insect that can be controlled by expressing in the plant the recombinant DNA construct according to this method. Plants of particular interest include commercially important plants, including row crop plants, vegetables, and fruits, and other plants of agricultural or decorative use. Examples of suitable plants are provided under the heading "Plants". The method is especially useful for providing an ornamental plant or a crop plant with improved resistance to flea beetles. Various embodiments of the method include those wherein the plant is a plant in the family Brassicaceae, including a *Brassica* species selected from the group consisting of *B. napus, B. juncea, B. carinata, B. rapa, B. oleracea, B. rupestris, B. sepficeps, B. nigra, B. narinosa, B. perviridus, B. tournefortii*, and *B. fructiculosa*. In other embodiments, the plant is selected from the group consisting of *Glycine max, Linum usitafissimum, Zea mays, Carthamus tinctorius, Helianthus annuus, Nicotiana tabacum, Arabidopsis thaliana, Betholettia excelsa, Ricinus communis, Cocus nucifera, Coriandrum sativum, Gossypium* spp., *Arachis hypogaea, Simmondsia chinensis, Solanum tuberosum, Elaeis guineensis, Olea europaea, Oryza sativa, Cucurbita maxim, Hordeum vulgare*, and *Trificum aestivum*. In an embodiment, the method provides a potato plant with improved resistance to *Epitrix cucumeris* (potato flea beetle).

Embodiments of the method provide a plant having improved resistance to one or more flea beetle species, e. g., a species of a genus selected from the group consisting of the genera *Altica, Anthobiodes, Aphthona, Aphthonaltica, Aphthonoides, Apteopeda, Argopistes, Argopus, Arrhenocoela, Batophila, Blepharida, Chaetocnema, Clitea, Crepidodera, Derocrepis, Dibolia, Disonycha, Epitrix, Hermipyxis, Hermaeophaga, Hespera, Hippuriphila, Horaia, Hyphasis, Lipromima, Liprus, Longitarsus, Luperomorpha, Lythraria, Manobia, Mantura, Meishania, Minota, Mniophila, Neicrepidodera, Nonarthra, Novofoudrasia, Ochrosis, Oedionychis, Oglobinia, Omeisphaera, Ophrida, Oresfia, Paragopus, Pentamesa, Philopona, Phygasia, Phyllotreta, Podagrica, Podagricomela, Podonfia, Pseudodera, Psylliodes, Sangariola, Sinaltica, Sphaeroderma, Systena, Trachyaphthona, Xuthea*, and *Zipangia*. In embodiments, the insect is selected from the group consisting of *Altica ambiens* (alder flea beetle), *Altica canadensis* (prairie flea beetle), *Altica chalybaea* (grape flea beetle), *Altica prasina* (poplar flea beetle), *Altica rosae* (rose flea beetle), *Altica sylvia* (blueberry flea beetle), *Altica ulmi* (elm flea beetle), *Chaetocnema pulicaria* (corn flea beele), *Chaetocnema conofinis* (sweet potato flea beetle), *Epitrix cucumeris* (potato flea beetle), *Systena blanda* (palestripped fleabeetle), and *Systena frontalis* (redheaded flea beetle). In embodiments, the method provides a plant having improved resistance to an insect selected from the group consisting of *Phyllotreta* armoraciae (horseradish flea beetle), *Phyllotreta cruciferae* (canola flea beetle), *Phyllotreta pusilla* (western black flea beetle), *Phyllotreta nemorum* (striped turnip flea beetle), *Phyllotreta* atra (turnip flea beetle), *Phyllotreta robusta* (garden flea beetle), *Phyllotreta striolata* (striped flea beetle), *Phyllotreta undulata, Psylliodes chrysocephala*, and *Psylliodes punctulata* (hop flea beetle).

In some embodiments, the method is developed for specific target genes in a given insect species. In some embodiments, a plant having improved resistance to *Phyllotreta* atra (turnip flea beetle), wherein the target gene has a DNA sequence selected from the group consisting of SEQ ID NOs:1-296, is provided. In some embodiments, a plant having improved resistance to *Phyllotreta cruciferae* (canola flea beetle), wherein the target gene has a DNA sequence selected from the group consisting of SEQ ID NOs:297-532, is provided. In some embodiments, a plant having improved resistance to *Phyllotreta striolata* (striped flea beetle), wherein the target gene has a DNA sequence selected from the group consisting of SEQ ID NOs:533-551, is provided. In some embodiments, a plant having improved resistance to *Psylliodes chrysocephala*, wherein the target gene has a DNA sequence selected from the group consisting of SEQ ID NOs:552-859, is provided. In some embodiments, a plant having improved resistance to *Phyllotreta* atra (turnip flea beetle) that expresses from a recombinant DNA construct a dsRNA strand comprising a sequence of about 95% to about 100% identity with a sequence selected from the group consisting of SEQ ID NOs:860-1155 or a fragment thereof is provided. In some embodiments, a plant having improved resistance to *Phyllotreta cruciferae* (canola flea beetle) that expresses from a recombinant DNA construct an insecticidal polynucleotide comprising a sequence of about 95% to about 100% identity with a sequence selected from the group consisting of SEQ ID NOs:1156-1391, 1731-1972, and 1974 or a fragment thereof is provided. In some embodiments, a plant having improved resistance to *Phyllotreta*

*striolata* (striped flea beetle) that expresses from a recombinant DNA construct an insecticidal polynucleotide comprising a strand comprising a sequence of about 95% to about 100% identity with a sequence selected from the group consisting of SEQ ID NOs:1392-1410, 1973, and 1975 or a fragment thereof is provided. In some embodiments, a plant having improved resistance to *Psylliodes chrysocephala* that expresses from a recombinant DNA construct an insecticidal polynucleotide comprising a strand comprising a sequence of about 95% to about 100% identity with a sequence selected from the group consisting of SEQ ID NOs:1411-1718 or a fragment thereof is provided.

Recombinant DNA Constructs Encoding Insecticidal Polynucleotides for Insect Control Several embodiments relate to a recombinant DNA construct comprising a heterologous promoter operably linked to DNA encoding an insecticidal polynucleotide transcript comprising a sequence of about 95% to about 100% (e. g., about 95%, about 96%, about 97%, about 98%, about 99%, or about 100%) identity or complementarity to at least 21 contiguous nucleotides of a sequence selected from the group consisting of SEQ ID NOs:860-1718 and 1722-1975 or a fragment thereof.

In some embodiments of the recombinant DNA construct, the insecticidal polynucleotide transcript comprises a sequence of about 95% to about 100% (e. g., about 95%, about 96%, about 97%, about 98%, about 99%, or about 100%) identity or complementarity with at least 21 contiguous nucleotides of a sequence selected from the group consisting of SEQ ID NOs:860-1718 and 1722-1975 or a fragment thereof. In some embodiments, the insecticidal polynucleotide transcript forms dsRNA double-stranded insecticidal polynucleotide. In some embodiments, the insecticidal polynucleotide transcript is a dsRNA comprising an RNA strand comprising at least one segment of 18 or more contiguous nucleotides of an RNA sequence selected from the group consisting of SEQ ID NOs:860-1718 and 1722-1975 or a fragment thereof. In some embodiments, the insecticidal polynucleotide transcript is a dsRNA comprising an RNA strand comprising at least one segment of 21 contiguous nucleotides of an RNA sequence selected from the group consisting of SEQ ID NOs:860-1718 and 1722-1975 or a fragment thereof. In some embodiments, the insecticidal polynucleotide transcript is a dsRNA comprising at least one RNA strand comprising a sequence of about 95% to about 100% identity or complementarity with a sequence selected from the group consisting of SEQ ID NOs:860-1718 and 1722-1975 or a fragment thereof. In some embodiments, the insecticidal polynucleotide transcript is a dsRNA comprising an RNA strand comprising a sequence selected from the group consisting of SEQ ID NOs:860-1718 and 1722-1975 or a fragment thereof. In some embodiments, the insecticidal polynucleotide transcript forms single-stranded insecticidal polynucleotide. In some embodiments, the insecticidal polynucleotide transcript is a ssRNA comprising at least one segment of 18 or more contiguous nucleotides of an RNA sequence selected from the group consisting of SEQ ID NOs:860-1718 and 1722-1975 or a fragment thereof. In some embodiments, the insecticidal polynucleotide transcript is a ssRNA comprising at least one segment of 21 contiguous nucleotides of an RNA sequence selected from the group consisting of SEQ ID NOs:860-1718 and 1722-1975 or a fragment thereof. In some embodiments, the insecticidal polynucleotide transcript is a ssRNA comprising a sequence of about 95% to about 100% identity or complementarity with a sequence selected from the group consisting of SEQ ID NOs:860-1718 and 1722-1975 or a fragment thereof. In some embodiments, the insecticidal polynucleotide transcript is a ssRNA comprising a sequence selected from the group consisting of SEQ ID NOs:860-1718 and 1722-1975 or a fragment thereof.

In some embodiments of the recombinant DNA construct, the heterologous promoter is functional for expression of the insecticidal polynucleotide transcript in a bacterium. In some embodiments where the recombinant DNA construct is to be expressed in a bacterium, the bacterium is selected from the group consisting of *Escherichia coli*, *Bacillus* species, *Pseudomonas* species, *Xenorhabdus* species, or *Photorhabdus* species. In other embodiments, the recombinant DNA construct comprises a heterologous promoter that is functional in a plant cell.

In some embodiments, the recombinant DNA construct is contained in a recombinant vector, such as a recombinant plant virus vector or a recombinant baculovirus vector. In embodiments, the recombinant DNA construct is integrated into a plant chromosome or plastid, e. g., by stable transformation.

Related aspects include a transgenic plant cell comprising in its genome the recombinant DNA construct, and a transgenic plant comprising such a transgenic plant cell. Transgenic plant cells and plants are made by methods known in the art, such as those described under the heading "Making and Using Transgenic Plant Cells and Transgenic Plants". Further aspects include a commodity product produced from such a transgenic plant, and transgenic progeny seed or propagatable plant part of the transgenic plant.

Related Information and Techniques

Plants

The methods and compositions described herein for treating and protecting plants from insect infestations are useful across a broad range of plants. Suitable plants in which the methods and compositions disclosed herein can be used include, but are not limited to, cereals and forage grasses (rice, maize, wheat, barley, oat, sorghum, pearl millet, finger millet, cool-season forage grasses, and bahiagrass), oilseed crops (soybean, oilseed brassicas including canola and oilseed rape, sunflower, peanut, flax, sesame, and safflower), legume grains and forages (common bean, cowpea, pea, fava bean, lentil, tepary bean, Asiatic beans, pigeonpea, vetch, chickpea, lupine, alfalfa, and clovers), temperate fruits and nuts (apple, pear, peach, plums, berry crops, cherries, grapes, olive, almond, and Persian walnut), tropical and subtropical fruits and nuts (citrus including limes, oranges, and grapefruit; banana and plantain, pineapple, papaya, mango, avocado, kiwifruit, passionfruit, and persimmon), vegetable crops (solanaceous plants including tomato, eggplant, and peppers; vegetable brassicas; radish, carrot, cucurbits, alliums, asparagus, and leafy vegetables), sugar, tuber, and fiber crops (sugarcane, sugar beet, stevia, potato, sweet potato, cassava, and cotton), plantation crops, ornamentals, and turf grasses (tobacco, coffee, cocoa, tea, rubber tree, medicinal plants, ornamentals, and turf grasses), and forest tree species. Specific plant species of interest are plants in the family Brassicaceae, including the *Brassica* species *B. napus, B. juncea, B. carinata, B. rapa, B. oleracea, B. rupestris, B. sepficeps, B. nigra, B. narinosa, B. perviridus, B. toumefortii,* and *B. frucficulosa*. Additional plant species of interest are *Glycine max, Linum usitatissimum, Zea mays, Carthamus tinctorius, Helianthus annuus, Nicotiana tabacum, Arabidopsis thaliana, Betholettia excelsa, Ricinus communis, Cocos nucifera, Coriandrum sativum, Gossypium* spp., *Arachis hypogaea, Simmondsia*

*chinensis, Solanum tuberosum, Elaeis guineensis, Olea europaea, Oryza sativa, Cucurbita maxim, Hordeum vulgare*, and *Triticum aestivum*.

Additional Construct Elements

Embodiments of the polynucleotides and nucleic acid molecules disclosed herein can comprise additional elements, such as promoters, small RNA recognition sites, aptamers or ribozymes, additional and additional expression cassettes for expressing coding sequences (e. g., to express a transgene such as an insecticidal protein or selectable marker) or non-coding sequences (e. g., to express additional suppression elements). For example, an aspect provides a recombinant DNA construct comprising a heterologous promoter operably linked to DNA encoding an RNA transcript comprising a sequence of about 95% to about 100% identity or complementarity with a sequence selected from the group consisting of SEQ ID NOs:860-1718 and 1722-1975 or a fragment thereof. In another embodiment, a recombinant DNA construct comprising a promoter operably linked to DNA encoding: (a) an RNA transcript comprising a sequence of about 95% to about 100% identity or complementarity with a sequence selected from the group consisting of SEQ ID NOs:860-1718 and 1722-1975 or a fragment thereof, and (b) an aptamer, is stably integrated into the plant's genome from where RNA transcripts comprising the RNA aptamer and the RNA silencing element are expressed in cells of the plant; the aptamer serves to guide the RNA silencing element to a desired location in the cell. In another embodiment, inclusion of one or more recognition sites for binding and cleavage by a small RNA (e. g., by a miRNA or an siRNA that is expressed only in a particular cell or tissue) allows for more precise expression patterns in a plant, wherein the expression of the recombinant DNA construct is suppressed where the small RNA is expressed. Such additional elements are described below.

Promoters

Promoters of use in the compositions and methods disclosed herein are functional in the cell in which the construct is intended to be transcribed. Generally these promoters are heterologous promoters, as used in recombinant constructs, i. e., they are not in nature found to be operably linked to the other nucleic elements used in the constructs. In various embodiments, the promoter is selected from the group consisting of a constitutive promoter, a spatially specific promoter, a temporally specific promoter, a developmentally specific promoter, and an inducible promoter. In many embodiments the promoter is a promoter functional in a plant, for example, a pol II promoter, a pol III promoter, a pol IV promoter, or a pol V promoter.

Non-constitutive promoters suitable for use with the recombinant DNA constructs disclosed herein include spatially specific promoters, temporally specific promoters, and inducible promoters. Spatially specific promoters can include organelle-, cell-, tissue-, or organ-specific promoters (e. g., a plastid-specific, a root-specific, a pollen-specific, or a seed-specific promoter for expression in plastids, roots, pollen, or seeds, respectively). In many cases a seed-specific, embryo-specific, aleurone-specific, or endosperm-specific promoter is especially useful. Temporally specific promoters can include promoters that tend to promote expression during certain developmental stages in a plant's growth cycle, or during different times of day or night, or at different seasons in a year. Inducible promoters include promoters induced by chemicals or by environmental conditions such as, but not limited to, biotic or abiotic stress (e. g., water deficit or drought, heat, cold, high or low nutrient or salt levels, high or low light levels, or pest or pathogen infection). MicroRNA promoters are useful, especially those having a temporally specific, spatially specific, or inducible expression pattern; examples of miRNA promoters, as well as methods for identifying miRNA promoters having specific expression patterns, are provided in U.S. Patent Application Publications 2006/0200878, 2007/0199095, and 2007/0300329, which are specifically incorporated herein by reference. An expression-specific promoter can also include promoters that are generally constitutively expressed but at differing degrees or "strengths" of expression, including promoters commonly regarded as "strong promoters" or as "weak promoters".

Promoters include the following examples: an opaline synthase promoter isolated from T-DNA of *Agrobacterium*; a cauliflower mosaic virus 35S promoter; enhanced promoter elements or chimeric promoter elements such as an enhanced cauliflower mosaic virus (CaMV) 35S promoter linked to an enhancer element (an intron from heat shock protein 70 of *Zea mays*); root specific promoters such as those disclosed in U.S. Pat. Nos. 5,837,848; 6,437,217 and 6,426,446; a maize L3 oleosin promoter disclosed in U.S. Pat. No. 6,433,252; a promoter for a plant nuclear gene encoding a plastid-localized aldolase disclosed in U.S. Patent Application Publication 2004/0216189; cold-inducible promoters disclosed in U.S. Pat. No. 6,084,089; salt-inducible promoters disclosed in U.S. Pat. No. 6,140,078; light-inducible promoters disclosed in U.S. Pat. No. 6,294,714; pathogen-inducible promoters disclosed in U.S. Pat. No. 6,252,138; and water deficit-inducible promoters disclosed in U.S. Patent Application Publication 2004/0123347 A1. All of the above-described patents and patent publications disclosing promoters and their use, especially in recombinant DNA constructs functional in plants are incorporated herein by reference.

Plant vascular- or phloem-specific promoters of interest include a rolC or rolA promoter of *Agrobacterium rhizogenes*, a promoter of a *Agrobacterium tumefaciens* T-DNA gene 5, the rice sucrose synthase RSs1 gene promoter, a *Commelina* yellow mottle badnavirus promoter, a coconut foliar decay virus promoter, a rice tungro bacilliform virus promoter, the promoter of a pea glutamine synthase GS3A gene, a invCD111 and invCD141 promoters of a potato invertase genes, a promoter isolated from *Arabidopsis* shown to have phloem-specific expression in tobacco by Kertbundit et al. (1991) *Proc. Natl. Acad. Sci. USA*, 88:5212-5216, a VAHOX1 promoter region, a pea cell wall invertase gene promoter, an acid invertase gene promoter from carrot, a promoter of a sulfate transporter gene Sultr1; 3, a promoter of a plant sucrose synthase gene, and a promoter of a plant sucrose transporter gene.

Promoters suitable for use with a recombinant DNA construct or polynucleotide disclosed herein include polymerase II ("pol II") promoters and polymerase III ("pol III") promoters. RNA polymerase II transcribes structural or catalytic RNAs that are usually shorter than 400 nucleotides in length, and recognizes a simple run of T residues as a termination signal; it has been used to transcribe siRNA duplexes (see, e. g., Lu et al. (2004) *Nucleic Acids Res.*, 32:e171). Pol II promoters are therefore preferred in certain embodiments where a short RNA transcript is to be produced from a recombinant DNA construct. In one embodiment, the recombinant DNA construct includes a pol II promoter to express an RNA transcript flanked by self-cleaving ribozyme sequences (e. g., self-cleaving hammerhead ribozymes), resulting in a processed RNA, such as a single-stranded RNA that binds to the transcript of the flea beetle target gene, with defined 5' and 3' ends, free of potentially interfering flanking sequences. An alternative approach uses pol III promoters to generate transcripts with relatively defined 5' and 3' ends, i. e., to transcribe an RNA with minimal 5' and 3' flanking sequences. In some embodiments, Pol III promoters (e. g., U6 or H1 promoters) are preferred for adding a short AT-rich transcription termination site that results in 2 base-pair overhangs (UU) in the transcribed RNA; this is useful, e. g., for expression of siRNA-type constructs. Use of pol III promoters for driving expression of siRNA constructs has been reported; see van de Wetering et al. (2003) *EMBO Rep.*, 4: 609-615, and Tuschl (2002) *Nature Biotechnol.*, 20: 446-448. Baculovirus promoters such as baculovirus polyhedrin and p10 promoters are known in the art and commercially available; see, e. g., Invitrogen's "Guide to Baculovirus Expression Vector Systems (BEVS) and Insect Cell Culture Techniques", 2002 (Life Technologies, Carlsbad, Calif.) and F. J. Haines et al. "Baculovirus Expression Vectors", undated (Oxford Expression Technologies, Oxford, UK).

The promoter element can include nucleic acid sequences that are not naturally occurring promoters or promoter elements or homologues thereof but that can regulate expression of a gene. Examples of such "gene independent" regulatory sequences include naturally occurring or artificially designed RNA sequences that comprise a ligand-binding region or aptamer (see "Aptamers", below) and a regulatory region (which can be cis-acting). See, for example, Isaacs et al. (2004) *Nat. Biotechnol.*, 22:841-847, Bayer and Smolke (2005) *Nature Biotechnol.*, 23:337-343, Mandal and Breaker (2004) *Nature Rev. Mol. Cell Biol.*, 5:451-463, Davidson and Ellington (2005) *Trends Biotechnol.*, 23:109-112, Winkler et al. (2002) *Nature*, 419:952-956, Sudarsan et al. (2003) RNA, 9:644-647, and Mandal and Breaker (2004) *Nature Struct. Mol. Biol.*, 11:29-35. Such "riboregulators" could be selected or designed for specific spatial or temporal specificity, for example, to regulate translation of DNA that encodes a silencing element for suppressing a target gene only in the presence (or absence) of a given concentration of the appropriate ligand. One example is a riboregulator that is responsive to an endogenous ligand (e. g., jasmonic acid or salicylic acid) produced by the plant when under stress (e. g., abiotic stress such as water, temperature, or nutrient stress, or biotic stress such as attach by pests or pathogens); under stress, the level of endogenous ligand increases to a level sufficient for the riboregulator to begin transcription of the DNA that encodes a silencing element for suppressing a target gene.

Transgene Transcription Units

In some embodiments, the recombinant DNA construct or polynucleotide disclosed herein comprises a transgene transcription unit. A transgene transcription unit comprises DNA sequence encoding a gene of interest, e. g., a natural protein or a heterologous protein. A gene of interest can be any coding or non-coding sequence from any species (including, but not limited to, non-eukaryotes such as bacteria, and viruses; fungi, protists, plants, invertebrates, and vertebrates. Particular genes of interest are genes encoding one or more proteins conferring resistance to an herbicide and genes encoding at least one pesticidal agent selected from the group consisting of a patatin, a plant lectin, a phytoecdysteroid, a *Bacillus thuringiensis* insecticidal protein, a *Xenorhabdus* insecticidal protein, a *Photorhabdus* insecticidal protein, a *Bacillus* laterosporous insecticidal protein, a *Bacillus sphaericus* insecticidal protein, and an insecticidal protein produced by any of *Lysinibacillus sphaericus* (*Bacillus sphaericus*), *Brevibacillus laterosporus* (*Bacillus laterosporus*), *Chromobacterium* species, *Chromobacterium sub- tsugae*, *Paenibacillus* species, *Paenibacillus lentimorbus*, and *Paenibacillus popilliae*. The transgene transcription unit can further comprise 5' or 3' sequence or both as required for transcription of the transgene.

Introns

In some embodiments, the recombinant DNA construct or polynucleotide comprises DNA encoding a spliceable intron. By "intron" is generally meant a segment of DNA (or the RNA transcribed from such a segment) that is located between exons (protein-encoding segments of the DNA or corresponding transcribed RNA), wherein, during maturation of the messenger RNA, the intron present is enzymatically "spliced out" or removed from the RNA strand by a cleavage/ligation process that occurs in the nucleus in eukaryotes. The term "intron" is also applied to non-coding DNA sequences that are transcribed to RNA segments that can be spliced out of a maturing RNA transcript, but are not introns found between protein-coding exons. One example of these are spliceable sequences that that have the ability to enhance expression in plants (in some cases, especially in monocots) of a downstream coding sequence; these spliceable sequences are naturally located in the 5' untranslated region of some plant genes, as well as in some viral genes (e. g., the tobacco mosaic virus 5' leader sequence or "omega" leader described as enhancing expression in plant genes by Gallie and Walbot (1992) *Nucleic Acids Res.*, 20:4631-4638). These spliceable sequences or "expression-enhancing introns" can be artificially inserted in the 5' untranslated region of a plant gene between the promoter but before any protein-coding exons. Examples of such expression-enhancing introns include, but are not limited to, a maize alcohol dehydrogenase (Zm-Adh1), a maize Bronze-1 expression-enhancing intron, a rice actin 1 (Os-Act1) intron, a Shrunken-1 (Sh-1) intron, a maize sucrose synthase intron, a heat shock protein 18 (hsp18) intron, and an 82 kilodalton heat shock protein (hsp82) intron. U.S. Pat. Nos. 5,593,874 and 5,859,347, specifically incorporated by reference herein, describe methods of improving recombinant DNA constructs for use in plants by inclusion of an expression-enhancing intron derived from the 70 kilodalton maize heat shock protein (hsp70) in the non-translated leader positioned 3' from the gene promoter and 5' from the first protein-coding exon.

Gene Suppression Elements

In some embodiments, the recombinant DNA construct or polynucleotide comprises DNA encoding additional gene suppression element for suppressing a target gene other than a flea beetle target gene. The target gene to be suppressed can include coding or non-coding sequence or both.

Suitable gene suppression elements are described in detail in U.S. Patent Application Publication 2006/0200878, which disclosure is specifically incorporated herein by reference, and include one or more of:

(a) DNA that comprises at least one anti-sense DNA segment that is anti-sense to at least one segment of the gene to be suppressed;

(b) DNA that comprises multiple copies of at least one anti-sense DNA segment that is anti-sense to at least one segment of the gene to be suppressed;

(c) DNA that comprises at least one sense DNA segment that is at least one segment of the gene to be suppressed;

(d) DNA that comprises multiple copies of at least one sense DNA segment that is at least one segment of the gene to be suppressed;

(e) DNA that transcribes to RNA for suppressing the gene to be suppressed by forming double-stranded RNA and comprises at least one anti-sense DNA segment that is anti-sense to at least one segment of the gene to be suppressed and at least one sense DNA segment that is at least one segment of the gene to be suppressed;

(f) DNA that transcribes to RNA for suppressing the gene to be suppressed by forming a single double-stranded RNA and comprises multiple serial anti-sense DNA segments that are anti-sense to at least one segment of the gene to be suppressed and multiple serial sense DNA segments that are at least one segment of the gene to be suppressed;

(g) DNA that transcribes to RNA for suppressing the gene to be suppressed by forming multiple double strands of RNA and comprises multiple anti-sense DNA segments that are anti-sense to at least one segment of the gene to be suppressed and multiple sense DNA segments that are at least one segment of the gene to be suppressed, and wherein the multiple anti-sense DNA segments and the multiple sense DNA segments are arranged in a series of inverted repeats;

(h) DNA that comprises nucleotides derived from a plant miRNA;

(i) DNA that comprises nucleotides of a siRNA;

(j) DNA that transcribes to an RNA aptamer capable of binding to a ligand; and (k) DNA that transcribes to an RNA aptamer capable of binding to a ligand, and DNA that transcribes to regulatory RNA capable of regulating expression of the gene to be suppressed, wherein the regulation is dependent on the conformation of the regulatory RNA, and the conformation of the regulatory RNA is allosterically affected by the binding state of the RNA aptamer.

In some embodiments, an intron is used to deliver a gene suppression element in the absence of any protein-coding exons (coding sequence). In one example, an intron, such as an expression-enhancing intron (preferred in certain embodiments), is interrupted by embedding within the intron a gene suppression element, wherein, upon transcription, the gene suppression element is excised from the intron. Thus, protein-coding exons are not required to provide the gene suppressing function of the recombinant DNA constructs disclosed herein.

Transcription Regulatory Elements

In some embodiments, the recombinant DNA construct or polynucleotide comprises DNA encoding a transcription regulatory element. Transcription regulatory elements include elements that regulate the expression level of the recombinant DNA construct (relative to its expression in the absence of such regulatory elements). Examples of suitable transcription regulatory elements include riboswitches (cis- or trans-acting), transcript stabilizing sequences, and miRNA recognition sites, as described in detail in U.S. Patent Application Publication 2006/0200878, specifically incorporated herein by reference.

Transgenic Plant Cells and Transgenic Plants

The recombinant DNA constructs disclosed herein can be stacked with other recombinant DNA for imparting additional traits (e. g., in the case of transformed plants, traits including herbicide resistance, pest resistance, cold germination tolerance, water deficit tolerance, and the like) for example, by expressing or suppressing other genes. Constructs for coordinated decrease and increase of gene expression are disclosed in U.S. Patent Application Publication 2004/0126845 A1, specifically incorporated by reference.

In certain transgenic plant cells and transgenic plants, it is sometimes desirable to concurrently express a gene of interest while also modulating expression of a flea beetle target gene. Thus, in some embodiments, the transgenic plant contains recombinant DNA further comprising a gene expression element for expressing at least one gene of interest, and transcription of the recombinant DNA construct for flea beetle control is preferably effected with concurrent transcription of the gene expression element. In embodiments, the transgenic plant expresses DNA encoding a insecticidal polynucleotide transcript as disclosed herein for suppression of a flea beetle target gene, and also expresses DNA encoding a non-nucleotide pesticidal agent such as a small-molecule pesticidal agent or a proteinaceous pesticidal agent; such DNAs can be stacked in a single recombinant construct or expression cassette, or alternatively can be expressed from discrete recombinant constructs or expression cassettes. Examples of non-nucleotide pesticidal agents include patatins, plant lectins, phytoecdysteroids, and bacterial insecticidal proteins (e. g., insecticidal proteins from *Bacillus thuringiensis, Xenorhabdus* sp., *Photorhabdus* sp., *Brevibacillus laterosporus* (*Bacillus laterosporus*), *Lysinibacillus sphaericus* (*Bacillus sphaericus*), *Chromobacterium* sp., *Chromobacterium subtsugae, Paenibacillus* sp., *Paenibacillus lentimorbus*, and *Paenibacillus popilliae*). In embodiments, the transgenic plant expresses DNA encoding a recombinant RNA transcript as disclosed herein for suppression of a flea beetle target gene, and also expresses DNA encoding one or more proteins conferring tolerance to an herbicide. Examples of proteins conferring tolerance to an herbicide include 5-enolpyruvylshikimate-3-phosphate synthases (EPSPS; see, e. g., U.S. Pat. Nos. 5,627,061, 5,633,435 RE39247, 6,040,497, and 5,094,945, and PCT International Application Publications WO04074443 and WO04009761), glyphosate oxidoreductase (GOX; U.S. Pat. No. 5,463,175), glyphosate decarboxylase (PCT International Application Publication WO05003362, U.S. Pat. No. 7,405,347, and U.S. Patent Application Publication 2004/0177399), glyphosate-N-acetyl transferase (GAT; U.S. Pat. No. 7,714,188) conferring tolerance to glyphosate; dicamba monooxygenase conferring tolerance to auxin-like herbicides such as dicamba (U.S. Pat. No. 7,105,724); phosphinothricin acetyltransferase (pat or bar) conferring tolerance to phosphinothricin or glufosinate (U.S. Pat. No. 5,646,024); 2,2-dichloropropionic acid dehalogenase conferring tolerance to 2,2-dichloropropionic acid (Dalapon) (PCT International Application Publication WO9927116); acetohydroxyacid synthase or acetolactate synthase conferring tolerance to acetolactate synthase inhibitors such as sulfonylurea, imidazolinone, triazolopyrimidine, pyrimidyloxybenzoates and phthalide (U.S. Pat. No. 6,225,105); haloarylnitrilase (Bxn) for conferring tolerance to bromoxynil (U.S. Pat. No. 4,810,648); modified acetyl-coenzyme A carboxylase for conferring tolerance to cyclohexanedione (sethoxydim) and aryloxyphenoxypropionate (haloxyfop) (U.S. Pat. No. 6,414,222); dihydropteroate synthase (sul 1) for conferring tolerance to sulfonamide herbicides (U.S. Pat. No. 5,719,046); 32 kDa photosystem II polypeptide (psbA) for conferring tolerance to triazine herbicides (Hirschberg et al., 1983, Science, 222:1346-1349); anthranilate synthase for conferring tolerance to 5-methyltryptophan (U.S. Pat. No. 4,581,847); dihydrodipicolinic acid synthase (dap A) for conferring to tolerance to aminoethyl cysteine (PCT International Application Publication WO8911789); phytoene desaturase (crtl) for conferring tolerance to pyridazinone herbicides such as norflurazon (Japan Patent JP06343473); hydroxyphenylpyruvate dioxygenase, a 4-hydroxyphenylacetic acid oxidase and a 4-hydroxyphenylacetic 1-hydrolase (U.S. Pat. No. 7,304,209) for conferring tolerance to cyclopropylisoxazole herbicides such as isoxaflutole (U.S.

Pat. No. 6,268,549); modified protoporphyrinogen oxidase I (protox) for conferring tolerance to protoporphyrinogen oxidase inhibitors (U.S. Pat. No. 5,939,602); aryloxyalkanoate dioxygenase (AAD-1) for conferring tolerance to an herbicide containing an aryloxyalkanoate moiety (WO05107437); a serine hydroxymethyltransferase (US Patent Application Publication 2008/0155716), a glufosinate-tolerant glutamine synthase (US Patent Application Publication 2009/0018016). Examples of such herbicides include phenoxy auxins (such as 2,4-D and dichlorprop), pyridyloxy auxins (such as fluroxypyr and triclopyr), aryloxyphenoxypropionates (AOPP) acetylcoenzyme A carboxylase (ACCase) inhibitors (such as haloxyfop, quizalofop, and diclofop), and 5-substituted phenoxyacetate protoporphyrinogen oxidase IX inhibitors (such as pyraflufen and flumiclorac). The nucleotide sequences of the nucleic acids encoding herbicide-tolerance proteins and the sequences of the herbicide-tolerance proteins, as disclosed in the U.S. patent and patent application publications cited in this paragraph are incorporated herein by reference.

In some embodiments, the recombinant DNA constructs disclosed herein can be transcribed in any plant cell or tissue or in a whole plant of any developmental stage. Transgenic plants can be derived from any monocot or dicot plant, such as, but not limited to, plants of commercial or agricultural interest, such as crop plants (especially crop plants used for human food or animal feed), wood- or pulp-producing trees, vegetable plants, fruit plants, and ornamental plants. Examples of plants of interest include grain crop plants (such as wheat, oat, barley, maize, rye, triticale, rice, millet, sorghum, quinoa, amaranth, and buckwheat); forage crop plants (such as forage grasses and forage dicots including alfalfa, vetch, clover, and the like); oilseed crop plants (such as cotton, safflower, sunflower, soybean, canola, rapeseed, flax, peanuts, and oil palm); tree nuts (such as walnut, cashew, hazelnut, pecan, almond, and the like); sugarcane, coconut, date palm, olive, sugarbeet, tea, and coffee; wood- or pulp-producing trees; vegetable crop plants such as legumes (for example, beans, peas, lentils, alfalfa, peanut), lettuce, asparagus, artichoke, celery, carrot, radish, the brassicas (for example, cabbages, kales, mustards, and other leafy brassicas, broccoli, cauliflower, Brussels sprouts, turnip, kohlrabi), edible cucurbits (for example, cucumbers, melons, summer squashes, winter squashes), edible alliums (for example, onions, garlic, leeks, shallots, chives), edible members of the Solanaceae (for example, tomatoes, eggplants, potatoes, peppers, groundcherries), and edible members of the Chenopodiaceae (for example, beet, chard, spinach, quinoa, amaranth); fruit crop plants such as apple, pear, citrus fruits (for example, orange, lime, lemon, grapefruit, and others), stone fruits (for example, apricot, peach, plum, nectarine), banana, pineapple, grape, kiwifruit, papaya, avocado, and berries; plants grown for biomass or biofuel (for example, *Miscanthus* grasses, switchgrass, jatropha, oil palm, eukaryotic microalgae such as *Botryococcus braunii*, *Chlorella* spp., and *Dunaliella* spp., and eukaryotic macroalgae such as *Gracilaria* spp., and *Sargassum* spp.); and ornamental plants including ornamental flowering plants, ornamental trees and shrubs, ornamental groundcovers, and ornamental grasses. Specific plant species of interest in which a recombinant DNA construct is transcribed to provide resistance to flea beetles are plants in the family Brassicaceae, including the *Brassica* species *B. napus*, *B. juncea*, *B. carinata*, *B. rapa*, *B. oleracea*, *B. rupestris*, *B. sepficeps*, *B. nigra*, *B. narinosa*, *B. perviridus*, *B. tournefortii*, and *B. frucficulosa*. Additional plant species of interest in which a recombinant DNA construct is transcribed to provide resistance to flea beetles are *Glycine max*, *Linum usitatissimum*, *Zea mays*, *Carthamus tinctorius*, *Helianthus annuus*, *Nicotiana tabacum*, *Arabidopsis thaliana*, *Betholettia excelsa*, *Ricinus communis*, *Cocos nucifera*, *Coriandrum sativum*, *Gossypium* spp., *Arachis hypogaea*, *Simmondsia chinensis*, *Solanum tuberosum*, *Elaeis guineensis*, *Olea europaea*, *Oryza sativa*, *Cucurbita maxim*, *Hordeum vulgare*, and *Triticum aestivum*.

Also disclosed herein are commodity products produced from a transgenic plant cell, plant, or seed expressing a recombinant DNA construct imparting improved resistance to flea beetles as disclosed herein, including, but not limited to, harvested leaves, roots, shoots, tubers, stems, fruits, seeds, or other parts of a plant, meals, oils, extracts, fermentation or digestion products, crushed or whole grains or seeds of a plant, or any food or non-food product including such commodity products produced from a transgenic plant cell, plant, or seed as disclosed herein. The detection of one or more of nucleic acid sequences of the recombinant DNA constructs for flea beetle control as disclosed herein in one or more commodity or commodity products contemplated herein is de facto evidence that the commodity or commodity product contains or is derived from a transgenic plant cell, plant, or seed expressing such a recombinant DNA construct.

Generally a transgenic plant having in its genome a recombinant DNA construct as disclosed herein exhibits increased resistance to an insect infestation, specifically increased resistance to a flea beetle infestation. In various embodiments, for example, where the transgenic plant expresses a recombinant DNA construct for flea beetle control that is stacked with other recombinant DNA for imparting additional traits, the transgenic plant has at least one additional altered trait, relative to a plant lacking the recombinant DNA construct, selected from the group of traits consisting of:

(a) improved abiotic stress tolerance;
(b) improved biotic stress tolerance;
(c) modified primary metabolite composition;
(d) modified secondary metabolite composition;
(e) modified trace element, carotenoid, or vitamin composition;
(f) improved yield;
(g) improved ability to use nitrogen, phosphate, or other nutrients;
(h) modified agronomic characteristics;
(i) modified growth or reproductive characteristics; and
(j) improved harvest, storage, or processing quality.

In some embodiments, the transgenic plant is characterized by: improved tolerance of abiotic stress (e. g., tolerance of water deficit or drought, heat, cold, non-optimal nutrient or salt levels, non-optimal light levels) or of biotic stress (e. g., crowding, allelopathy, or wounding); by a modified primary metabolite (e. g., fatty acid, oil, amino acid, protein, sugar, or carbohydrate) composition; a modified secondary metabolite (e. g., alkaloids, terpenoids, polyketides, non-ribosomal peptides, and secondary metabolites of mixed biosynthetic origin) composition; a modified trace element (e. g., iron, zinc), carotenoid (e. g., beta-carotene, lycopene, lutein, zeaxanthin, or other carotenoids and xanthophylls), or vitamin (e. g., tocopherols) composition; improved yield (e. g., improved yield under non-stress conditions or improved yield under biotic or abiotic stress); improved ability to use nitrogen, phosphate, or other nutrients; modified agronomic characteristics (e. g., delayed ripening; delayed senescence; earlier or later maturity; improved shade tolerance; improved resistance to root or stalk lodging; improved resistance to "green snap" of stems; modified photoperiod response); modified growth or reproductive characteristics (e. g., intentional dwarfing; intentional male sterility, useful, e. g., in improved hybridization procedures; improved vegetative growth rate; improved germination; improved male or female fertility); improved harvest, storage, or processing quality (e. g., improved resistance to pests during storage, improved resistance to breakage, improved appeal to consumers); or any combination of these traits.

In another embodiment, transgenic seed, or seed produced by the transgenic plant, has modified primary metabolite (e. g., fatty acid, oil, amino acid, protein, sugar, or carbohydrate) composition, a modified secondary metabolite composition, a modified trace element, carotenoid, or vitamin composition, an improved harvest, storage, or processing quality, or a combination of these. In another embodiment, it can be desirable to change levels of native components of the transgenic plant or seed of a transgenic plant, for example, to decrease levels of an allergenic protein or glycoprotein or of a toxic metabolite.

EXAMPLES

Example 1

This example illustrates non-limiting embodiments of coding DNA sequences useful as target genes for controlling insect species and for making compositions for controlling insects and insect-resistant transgenic plants, and identifies insecticidal polynucleotide sequences useful for controlling insect species. More specifically, embodiments of target genes identified by name (annotation) and sequence identifier (SEQ ID NO.) for controlling flea beetles are provided in SEQ ID NOs:1-859, and embodiments of dsRNA sequences ranging in size from 135 to 352 base pairs and designed to suppress these target genes are provided in SEQ ID NOs.860-1718.

TABLE 1

| Target Gene SEQ ID NO. | dsRNA SEQ ID NO.* | Target Gene SEQ ID NO. | dsRNA SEQ ID NO.* | Target Gene SEQ ID NO. | dsRNA SEQ ID NO.* | Target Gene SEQ ID NO. | dsRNA SEQ ID NO.* |
|---|---|---|---|---|---|---|---|
| 1 | 860 | 216 | 1075 | 431 | 1290 | 646 | 1505 |
| 2 | 861 | 217 | 1076 | 432 | 1291 | 647 | 1506 |
| 3 | 862 | 218 | 1077 | 433 | 1292 | 648 | 1507 |
| 4 | 863 | 219 | 1078 | 434 | 1293 | 649 | 1508 |
| 5 | 864 | 220 | 1079 | 435 | 1294 | 650 | 1509 |
| 6 | 865 | 221 | 1080 | 436 | 1295 | 651 | 1510 |
| 7 | 866 | 222 | 1081 | 437 | 1296 | 652 | 1511 |
| 8 | 867 | 223 | 1082 | 438 | 1297 | 653 | 1512 |
| 9 | 868 | 224 | 1083 | 439 | 1298 | 654 | 1513 |
| 10 | 869 | 225 | 1084 | 440 | 1299 | 655 | 1514 |
| 11 | 870 | 226 | 1085 | 441 | 1300 | 656 | 1515 |
| 12 | 871 | 227 | 1086 | 442 | 1301 | 657 | 1516 |
| 13 | 872 | 228 | 1087 | 443 | 1302 | 658 | 1517 |
| 14 | 873 | 229 | 1088 | 444 | 1303 | 659 | 1518 |
| 15 | 874 | 230 | 1089 | 445 | 1304 | 660 | 1519 |
| 16 | 875 | 231 | 1090 | 446 | 1305 | 661 | 1520 |
| 17 | 876 | 232 | 1091 | 447 | 1306 | 662 | 1521 |
| 18 | 877 | 233 | 1092 | 448 | 1307 | 663 | 1522 |
| 19 | 878 | 234 | 1093 | 449 | 1308 | 664 | 1523 |
| 20 | 879 | 235 | 1094 | 450 | 1309 | 665 | 1524 |
| 21 | 880 | 236 | 1095 | 451 | 1310 | 666 | 1525 |
| 22 | 881 | 237 | 1096 | 452 | 1311 | 667 | 1526 |
| 23 | 882 | 238 | 1097 | 453 | 1312 | 668 | 1527 |
| 24 | 883 | 239 | 1098 | 454 | 1313 | 669 | 1528 |
| 25 | 884 | 240 | 1099 | 455 | 1314 | 670 | 1529 |
| 26 | 885 | 241 | 1100 | 456 | 1315 | 671 | 1530 |

TABLE 1-continued

| Target Gene SEQ ID NO. | dsRNA SEQ ID NO.* | Target Gene SEQ ID NO. | dsRNA SEQ ID NO.* | Target Gene SEQ ID NO. | dsRNA SEQ ID NO.* | Target Gene SEQ ID NO. | dsRNA SEQ ID NO.* |
|---|---|---|---|---|---|---|---|
| 27 | 886 | 242 | 1101 | 457 | 1316 | 672 | 1531 |
| 28 | 887 | 243 | 1102 | 458 | 1317 | 673 | 1532 |
| 29 | 888 | 244 | 1103 | 459 | 1318 | 674 | 1533 |
| 30 | 889 | 245 | 1104 | 460 | 1319 | 675 | 1534 |
| 31 | 890 | 246 | 1105 | 461 | 1320 | 676 | 1535 |
| 32 | 891 | 247 | 1106 | 462 | 1321 | 677 | 1536 |
| 33 | 892 | 248 | 1107 | 463 | 1322 | 678 | 1537 |
| 34 | 893 | 249 | 1108 | 464 | 1323 | 679 | 1538 |
| 35 | 894 | 250 | 1109 | 465 | 1324 | 680 | 1539 |
| 36 | 895 | 251 | 1110 | 466 | 1325 | 681 | 1540 |
| 37 | 896 | 252 | 1111 | 467 | 1326 | 682 | 1541 |
| 38 | 897 | 253 | 1112 | 468 | 1327 | 683 | 1542 |
| 39 | 898 | 254 | 1113 | 469 | 1328 | 684 | 1543 |
| 40 | 899 | 255 | 1114 | 470 | 1329 | 685 | 1544 |
| 41 | 900 | 256 | 1115 | 471 | 1330 | 686 | 1545 |
| 42 | 901 | 257 | 1116 | 472 | 1331 | 687 | 1546 |
| 43 | 902 | 258 | 1117 | 473 | 1332 | 688 | 1547 |
| 44 | 903 | 259 | 1118 | 474 | 1333 | 689 | 1548 |
| 45 | 904 | 260 | 1119 | 475 | 1334 | 690 | 1549 |
| 46 | 905 | 261 | 1120 | 476 | 1335 | 691 | 1550 |
| 47 | 906 | 262 | 1121 | 477 | 1336 | 692 | 1551 |
| 48 | 907 | 263 | 1122 | 478 | 1337 | 693 | 1552 |
| 49 | 908 | 264 | 1123 | 479 | 1338 | 694 | 1553 |
| 50 | 909 | 265 | 1124 | 480 | 1339 | 695 | 1554 |
| 51 | 910 | 266 | 1125 | 481 | 1340 | 696 | 1555 |
| 52 | 911 | 267 | 1126 | 482 | 1341 | 697 | 1556 |
| 53 | 912 | 268 | 1127 | 483 | 1342 | 698 | 1557 |
| 54 | 913 | 269 | 1128 | 484 | 1343 | 699 | 1558 |
| 55 | 914 | 270 | 1129 | 485 | 1344 | 700 | 1559 |
| 56 | 915 | 271 | 1130 | 486 | 1345 | 701 | 1560 |
| 57 | 916 | 272 | 1131 | 487 | 1346 | 702 | 1561 |
| 58 | 917 | 273 | 1132 | 488 | 1347 | 703 | 1562 |
| 59 | 918 | 274 | 1133 | 489 | 1348 | 704 | 1563 |
| 60 | 919 | 275 | 1134 | 490 | 1349 | 705 | 1564 |
| 61 | 920 | 276 | 1135 | 491 | 1350 | 706 | 1565 |
| 62 | 921 | 277 | 1136 | 492 | 1351 | 707 | 1566 |
| 63 | 922 | 278 | 1137 | 493 | 1352 | 708 | 1567 |
| 64 | 923 | 279 | 1138 | 494 | 1353 | 709 | 1568 |
| 65 | 924 | 280 | 1139 | 495 | 1354 | 710 | 1569 |
| 66 | 925 | 281 | 1140 | 496 | 1355 | 711 | 1570 |
| 67 | 926 | 282 | 1141 | 497 | 1356 | 712 | 1571 |
| 68 | 927 | 283 | 1142 | 498 | 1357 | 713 | 1572 |
| 69 | 928 | 284 | 1143 | 499 | 1358 | 714 | 1573 |
| 70 | 929 | 285 | 1144 | 500 | 1359 | 715 | 1574 |
| 71 | 930 | 286 | 1145 | 501 | 1360 | 716 | 1575 |
| 72 | 931 | 287 | 1146 | 502 | 1361 | 717 | 1576 |
| 73 | 932 | 288 | 1147 | 503 | 1362 | 718 | 1577 |
| 74 | 933 | 289 | 1148 | 504 | 1363 | 719 | 1578 |
| 75 | 934 | 290 | 1149 | 505 | 1364 | 720 | 1579 |
| 76 | 935 | 291 | 1150 | 506 | 1365 | 721 | 1580 |
| 77 | 936 | 292 | 1151 | 507 | 1366 | 722 | 1581 |
| 78 | 937 | 293 | 1152 | 508 | 1367 | 723 | 1582 |
| 79 | 938 | 294 | 1153 | 509 | 1368 | 724 | 1583 |
| 80 | 939 | 295 | 1154 | 510 | 1369 | 725 | 1584 |
| 81 | 940 | 296 | 1155 | 511 | 1370 | 726 | 1585 |
| 82 | 941 | 297 | 1156 | 512 | 1371 | 727 | 1586 |
| 83 | 942 | 298 | 1157 | 513 | 1372 | 728 | 1587 |
| 84 | 943 | 299 | 1158 | 514 | 1373 | 729 | 1588 |
| 85 | 944 | 300 | 1159 | 515 | 1374 | 730 | 1589 |
| 86 | 945 | 301 | 1160 | 516 | 1375 | 731 | 1590 |
| 87 | 946 | 302 | 1161 | 517 | 1376 | 732 | 1591 |
| 88 | 947 | 303 | 1162 | 518 | 1377 | 733 | 1592 |
| 89 | 948 | 304 | 1163 | 519 | 1378 | 734 | 1593 |
| 90 | 949 | 305 | 1164 | 520 | 1379 | 735 | 1594 |
| 91 | 950 | 306 | 1165 | 521 | 1380 | 736 | 1595 |
| 92 | 951 | 307 | 1166 | 522 | 1381 | 737 | 1596 |
| 93 | 952 | 308 | 1167 | 523 | 1382 | 738 | 1597 |
| 94 | 953 | 309 | 1168 | 524 | 1383 | 739 | 1598 |
| 95 | 954 | 310 | 1169 | 525 | 1384 | 740 | 1599 |
| 96 | 955 | 311 | 1170 | 526 | 1385 | 741 | 1600 |
| 97 | 956 | 312 | 1171 | 527 | 1386 | 742 | 1601 |
| 98 | 957 | 313 | 1172 | 528 | 1387 | 743 | 1602 |
| 99 | 958 | 314 | 1173 | 529 | 1388 | 744 | 1603 |
| 100 | 959 | 315 | 1174 | 530 | 1389 | 745 | 1604 |

TABLE 1-continued

| Target Gene SEQ ID NO. | dsRNA SEQ ID NO.* | Target Gene SEQ ID NO. | dsRNA SEQ ID NO.* | Target Gene SEQ ID NO. | dsRNA SEQ ID NO.* | Target Gene SEQ ID NO. | dsRNA SEQ ID NO.* | Target Gene SEQ ID NO. | dsRNA SEQ ID NO.* | Target Gene SEQ ID NO. | dsRNA SEQ ID NO.* | Target Gene SEQ ID NO. | dsRNA SEQ ID NO.* | Target Gene SEQ ID NO. | dsRNA SEQ ID NO.* |
|---|---|---|---|---|---|---|---|---|---|---|---|---|---|---|---|
| 101 | 960 | 316 | 1175 | 531 | 1390 | 746 | 1605 | 175 | 1034 | 390 | 1249 | 605 | 1464 | 820 | 1679 |
| 102 | 961 | 317 | 1176 | 532 | 1391 | 747 | 1606 | 176 | 1035 | 391 | 1250 | 606 | 1465 | 821 | 1680 |
| 103 | 962 | 318 | 1177 | 533 | 1392 | 748 | 1607 | 177 | 1036 | 392 | 1251 | 607 | 1466 | 822 | 1681 |
| 104 | 963 | 319 | 1178 | 534 | 1393 | 749 | 1608 | 178 | 1037 | 393 | 1252 | 608 | 1467 | 823 | 1682 |
| 105 | 964 | 320 | 1179 | 535 | 1394 | 750 | 1609 | 179 | 1038 | 394 | 1253 | 609 | 1468 | 824 | 1683 |
| 106 | 965 | 321 | 1180 | 536 | 1395 | 751 | 1610 | 180 | 1039 | 395 | 1254 | 610 | 1469 | 825 | 1684 |
| 107 | 966 | 322 | 1181 | 537 | 1396 | 752 | 1611 | 181 | 1040 | 396 | 1255 | 611 | 1470 | 826 | 1685 |
| 108 | 967 | 323 | 1182 | 538 | 1397 | 753 | 1612 | 182 | 1041 | 397 | 1256 | 612 | 1471 | 827 | 1686 |
| 109 | 968 | 324 | 1183 | 539 | 1398 | 754 | 1613 | 183 | 1042 | 398 | 1257 | 613 | 1472 | 828 | 1687 |
| 110 | 969 | 325 | 1184 | 540 | 1399 | 755 | 1614 | 184 | 1043 | 399 | 1258 | 614 | 1473 | 829 | 1688 |
| 111 | 970 | 326 | 1185 | 541 | 1400 | 756 | 1615 | 185 | 1044 | 400 | 1259 | 615 | 1474 | 830 | 1689 |
| 112 | 971 | 327 | 1186 | 542 | 1401 | 757 | 1616 | 186 | 1045 | 401 | 1260 | 616 | 1475 | 831 | 1690 |
| 113 | 972 | 328 | 1187 | 543 | 1402 | 758 | 1617 | 187 | 1046 | 402 | 1261 | 617 | 1476 | 832 | 1691 |
| 114 | 973 | 329 | 1188 | 544 | 1403 | 759 | 1618 | 188 | 1047 | 403 | 1262 | 618 | 1477 | 833 | 1692 |
| 115 | 974 | 330 | 1189 | 545 | 1404 | 760 | 1619 | 189 | 1048 | 404 | 1263 | 619 | 1478 | 834 | 1693 |
| 116 | 975 | 331 | 1190 | 546 | 1405 | 761 | 1620 | 190 | 1049 | 405 | 1264 | 620 | 1479 | 835 | 1694 |
| 117 | 976 | 332 | 1191 | 547 | 1406 | 762 | 1621 | 191 | 1050 | 406 | 1265 | 621 | 1480 | 836 | 1695 |
| 118 | 977 | 333 | 1192 | 548 | 1407 | 763 | 1622 | 192 | 1051 | 407 | 1266 | 622 | 1481 | 837 | 1696 |
| 119 | 978 | 334 | 1193 | 549 | 1408 | 764 | 1623 | 193 | 1052 | 408 | 1267 | 623 | 1482 | 838 | 1697 |
| 120 | 979 | 335 | 1194 | 550 | 1409 | 765 | 1624 | 194 | 1053 | 409 | 1268 | 624 | 1483 | 839 | 1698 |
| 121 | 980 | 336 | 1195 | 551 | 1410 | 766 | 1625 | 195 | 1054 | 410 | 1269 | 625 | 1484 | 840 | 1699 |
| 122 | 981 | 337 | 1196 | 552 | 1411 | 767 | 1626 | 196 | 1055 | 411 | 1270 | 626 | 1485 | 841 | 1700 |
| 123 | 982 | 338 | 1197 | 553 | 1412 | 768 | 1627 | 197 | 1056 | 412 | 1271 | 627 | 1486 | 842 | 1701 |
| 124 | 983 | 339 | 1198 | 554 | 1413 | 769 | 1628 | 198 | 1057 | 413 | 1272 | 628 | 1487 | 843 | 1702 |
| 125 | 984 | 340 | 1199 | 555 | 1414 | 770 | 1629 | 199 | 1058 | 414 | 1273 | 629 | 1488 | 844 | 1703 |
| 126 | 985 | 341 | 1200 | 556 | 1415 | 771 | 1630 | 200 | 1059 | 415 | 1274 | 630 | 1489 | 845 | 1704 |
| 127 | 986 | 342 | 1201 | 557 | 1416 | 772 | 1631 | 201 | 1060 | 416 | 1275 | 631 | 1490 | 846 | 1705 |
| 128 | 987 | 343 | 1202 | 558 | 1417 | 773 | 1632 | 202 | 1061 | 417 | 1276 | 632 | 1491 | 847 | 1706 |
| 129 | 988 | 344 | 1203 | 559 | 1418 | 774 | 1633 | 203 | 1062 | 418 | 1277 | 633 | 1492 | 848 | 1707 |
| 130 | 989 | 345 | 1204 | 560 | 1419 | 775 | 1634 | 204 | 1063 | 419 | 1278 | 634 | 1493 | 849 | 1708 |
| 131 | 990 | 346 | 1205 | 561 | 1420 | 776 | 1635 | 205 | 1064 | 420 | 1279 | 635 | 1494 | 850 | 1709 |
| 132 | 991 | 347 | 1206 | 562 | 1421 | 777 | 1636 | 206 | 1065 | 421 | 1280 | 636 | 1495 | 851 | 1710 |
| 133 | 992 | 348 | 1207 | 563 | 1422 | 778 | 1637 | 207 | 1066 | 422 | 1281 | 637 | 1496 | 852 | 1711 |
| 134 | 993 | 349 | 1208 | 564 | 1423 | 779 | 1638 | 208 | 1067 | 423 | 1282 | 638 | 1497 | 853 | 1712 |
| 135 | 994 | 350 | 1209 | 565 | 1424 | 780 | 1639 | 209 | 1068 | 424 | 1283 | 639 | 1498 | 854 | 1713 |
| 136 | 995 | 351 | 1210 | 566 | 1425 | 781 | 1640 | 210 | 1069 | 425 | 1284 | 640 | 1499 | 855 | 1714 |
| 137 | 996 | 352 | 1211 | 567 | 1426 | 782 | 1641 | 211 | 1070 | 426 | 1285 | 641 | 1500 | 856 | 1715 |
| 138 | 997 | 353 | 1212 | 568 | 1427 | 783 | 1642 | 212 | 1071 | 427 | 1286 | 642 | 1501 | 857 | 1716 |
| 139 | 998 | 354 | 1213 | 569 | 1428 | 784 | 1643 | 213 | 1072 | 428 | 1287 | 643 | 1502 | 858 | 1717 |
| 140 | 999 | 355 | 1214 | 570 | 1429 | 785 | 1644 | 214 | 1073 | 429 | 1288 | 644 | 1503 | 859 | 1718 |
| 141 | 1000 | 356 | 1215 | 571 | 1430 | 786 | 1645 | 215 | 1074 | 430 | 1289 | 645 | 1504 | | |
| 142 | 1001 | 357 | 1216 | 572 | 1431 | 787 | 1646 | | | | | | | | |
| 143 | 1002 | 358 | 1217 | 573 | 1432 | 788 | 1647 | | | | | | | | |
| 144 | 1003 | 359 | 1218 | 574 | 1433 | 789 | 1648 | | | | | | | | |
| 145 | 1004 | 360 | 1219 | 575 | 1434 | 790 | 1649 | | | | | | | | |
| 146 | 1005 | 361 | 1220 | 576 | 1435 | 791 | 1650 | | | | | | | | |
| 147 | 1006 | 362 | 1221 | 577 | 1436 | 792 | 1651 | | | | | | | | |
| 148 | 1007 | 363 | 1222 | 578 | 1437 | 793 | 1652 | | | | | | | | |
| 149 | 1008 | 364 | 1223 | 579 | 1438 | 794 | 1653 | | | | | | | | |
| 150 | 1009 | 365 | 1224 | 580 | 1439 | 795 | 1654 | | | | | | | | |
| 151 | 1010 | 366 | 1225 | 581 | 1440 | 796 | 1655 | | | | | | | | |
| 152 | 1011 | 367 | 1226 | 582 | 1441 | 797 | 1656 | | | | | | | | |
| 153 | 1012 | 368 | 1227 | 583 | 1442 | 798 | 1657 | | | | | | | | |
| 154 | 1013 | 369 | 1228 | 584 | 1443 | 799 | 1658 | | | | | | | | |
| 155 | 1014 | 370 | 1229 | 585 | 1444 | 800 | 1659 | | | | | | | | |
| 156 | 1015 | 371 | 1230 | 586 | 1445 | 801 | 1660 | | | | | | | | |
| 157 | 1016 | 372 | 1231 | 587 | 1446 | 802 | 1661 | | | | | | | | |
| 158 | 1017 | 373 | 1232 | 588 | 1447 | 803 | 1662 | | | | | | | | |
| 159 | 1018 | 374 | 1233 | 589 | 1448 | 804 | 1663 | | | | | | | | |
| 160 | 1019 | 375 | 1234 | 590 | 1449 | 805 | 1664 | | | | | | | | |
| 161 | 1020 | 376 | 1235 | 591 | 1450 | 806 | 1665 | | | | | | | | |
| 162 | 1021 | 377 | 1236 | 592 | 1451 | 807 | 1666 | | | | | | | | |
| 163 | 1022 | 378 | 1237 | 593 | 1452 | 808 | 1667 | | | | | | | | |
| 164 | 1023 | 379 | 1238 | 594 | 1453 | 809 | 1668 | | | | | | | | |
| 165 | 1024 | 380 | 1239 | 595 | 1454 | 810 | 1669 | | | | | | | | |
| 166 | 1025 | 381 | 1240 | 596 | 1455 | 811 | 1670 | | | | | | | | |
| 167 | 1026 | 382 | 1241 | 597 | 1456 | 812 | 1671 | | | | | | | | |
| 168 | 1027 | 383 | 1242 | 598 | 1457 | 813 | 1672 | | | | | | | | |
| 169 | 1028 | 384 | 1243 | 599 | 1458 | 814 | 1673 | | | | | | | | |
| 170 | 1029 | 385 | 1244 | 600 | 1459 | 815 | 1674 | | | | | | | | |
| 171 | 1030 | 386 | 1245 | 601 | 1460 | 816 | 1675 | | | | | | | | |
| 172 | 1031 | 387 | 1246 | 602 | 1461 | 817 | 1676 | | | | | | | | |
| 173 | 1032 | 388 | 1247 | 603 | 1462 | 818 | 1677 | | | | | | | | |
| 174 | 1033 | 389 | 1248 | 604 | 1463 | 819 | 1678 | | | | | | | | |

*RNA sequences are provided for the anti-sense strand of the dsRNA in 5' to 3' direction.
**T44966 and T44967 are positive controls based on a Phyllotreta striolata arginine kinase mRNA disclosed in Zhao et al. (2008), Eur. J. Entomol., 5:815.

The embodiments of dsRNA sequences provided in Table 1 are generally useful for RNA-mediated suppression of the corresponding target gene identified in Table 1. These dsRNAs are useful for controlling insects, especially flea beetles, including the source species from which the target genes in Table 1 were identified. RNA-mediated suppression of one or more of the target genes provided in Table 1, or use of one or more of the dsRNAs provided in Table 1, is useful for causing mortality or stunting, or otherwise controlling, target insect species in the following genera: *Altica, Anthobiodes, Aphthona, Aphthonaltica, Aphthonoides, Apteopeda, Argopistes, Argopus, Arrhenocoela, Batophila, Blepharida, Chaetocnema, Clitea, Crepidodera, Derocrepis, Dibolia, Disonycha, Epitrix, Hermipyxis, Hermaeophaga, Hespera, Hippuriphila, Horaia, Hyphasis, Lipromima, Liprus, Longitarsus, Luperomorpha, Lythraria, Manobia, Mantura, Meishania, Minota, Mniophila, Neicrepidodera, Nonarthra, Novofoudrasia, Ochrosis, Oedionychis, Oglobinia, Omeisphaera, Ophrida, Oresfia, Paragopus, Pentamesa, Philopona, Phygasia, Phyllotreta, Podagrica, Podagricomela, Podonfia, Pseudodera, Psylliodes, Sangariola, Sinaltica, Sphaeroderma, Systena, Trachyaphthona, Xuthea,* and *Zipangia*. In embodiments, compositions comprising a dsRNA for suppression of one or more of the target genes provided in Table 1 (e. g., a composition comprising an effective amount of one or more of the dsRNAs provided in Table 1) are useful for controlling at least one of *Altica ambiens* (alder flea beetle), *Altica canadensis* (prairie flea beetle), *Altica chalybaea* (grape flea beetle), *Altica prasina* (poplar flea beetle), *Altica rosae* (rose flea beetle), *Altica sylvia* (blueberry flea beetle), *Altica ulmi* (elm flea beetle), *Chaetocnema pulicaria* (corn flea beele), *Chaetocnema conofinis* (sweet potato flea beetle), *Epitrix cucumeris* (potato flea beetle), *Systena blanda* (palestripped fleabeetle), and *Systena frontalis* (redheaded flea beetle), thus preventing or treating plant infestation by these species. For example, a composition comprising an effective amount of one or more of the dsRNAs provided in Table 1 is useful for preventing or treating infestation of potato plants by *Epitrix cucumeris* (potato flea beetle).

In embodiments, RNA-mediated suppression of one or more of the target genes provided in Table 1, or use of one or more of the dsRNAs provided in Table 1, is useful for causing mortality or stunting in flea beetle species in the genera *Phyllotreta* and *Psylliodes*, thus preventing or treating plant infestation by these species. In specific embodiments, RNA-mediated suppression of one or more of the target genes provided in Table 1, or use of one or more of the dsRNAs provided in Table 1, is useful for causing mortality or stunting in at least one flea beetle species selected from the group consisting of *Phyllotreta armoraciae* (horseradish flea beetle), *Phyllotreta cruciferae* (canola flea beetle), *Phyllotreta pusilla* (western black flea beetle), *Phyllotreta nemorum* (striped turnip flea beetle), *Phyllotreta atra* (turnip flea beetle), *Phyllotreta robusta* (garden flea beetle), *Phyllotreta striolata* (striped flea beetle), *Phyllotreta undulata, Psylliodes chrysocephala*, and *Psylliodes punctulata* (hop flea beetle). In embodiments, RNA-mediated suppression of one or more of the target genes having a sequence selected from the group consisting of SEQ ID NOs:1-296 is used to cause mortality or stunting in *Phyllotreta atra* (turnip flea beetle) adults or larvae, for example, by contacting *Phyllotreta atra* adults, larvae, or eggs with an effective amount of a dsRNA comprising a sequence selected from the group consisting of SEQ ID NOs:860-1155. In embodiments, RNA-mediated suppression of one or more of the target genes having a sequence selected from the group consisting of SEQ ID NOs:297-532 is used to cause mortality or stunting in *Phyllotreta cruciferae* (canola flea beetle) adults or larvae, for example, by contacting *Phyllotreta cruciferae* adults, larvae, or eggs with an effective amount of a dsRNA comprising a sequence selected from the group consisting of SEQ ID NOs:1156-1391, 1731-1972, and 1974. In embodiments, RNA-mediated suppression of one or more of the target genes having a sequence selected from the group consisting of SEQ ID NOs:533-551 is used to cause mortality or stunting in *Phyllotreta striolata* (striped flea beetle) adults or larvae, for example, by contacting *Phyllotreta striolata* adults, larvae, or eggs with an effective amount of a dsRNA comprising a sequence selected from the group consisting of SEQ ID NOs:1392-1410, 1973, and 1975. In embodiments, RNA-mediated suppression of one or more of the target genes having a sequence selected from the group consisting of SEQ ID NOs:552-859 is used to cause mortality or stunting in *Psylliodes chrysocephala* adults or larvae, for example, by contacting *Psylliodes chrysocephala* adults, larvae, or eggs with an effective amount of a dsRNA comprising a sequence selected from the group consisting of SEQ ID NOs:1411-1718.

Plants which can be protected by such infestation by transgenic expression or topical application of one or more of the dsRNAs provided in Table 1 include any plant species or variety that is subject to infestation by flea beetles, especially plants of economic importance, including ornamental plants and crop plants. Embodiments of such plants include plants in the family Brassicaceae (mustard family), such as a plant in the genus *Brassica* including, for example, one of the following: *B. napus* (rapeseed, including cultivars such as canola and rutabaga), *B. juncea* (Indian mustard), *B. carinata* (Abyssinian mustard), *B. rapa* (turnip), *B. oleracea* (wild cabbage, including domesticated cultivars such as, kale, cabbage, broccoli, cauliflower, brussels sprouts, etc.) *B. rupestris* (brown mustard), *B. sepficeps* (seventop mustard), *B. nigra* (black mustard), *B. narinosa* (broadbeaked mustard), *B. perviridus* (mustard spinach), *B. tournefortii* (asian mustard), and *B. frucficulosa* (Mediterranean cabbage). In additional embodiments, the target plants may include, but not limited to, one of the following: *Glycine max* (soybean), *Linum usitatissimum* (linseed/flax), *Zea mays* (maize), *Carthamus tinctorius* (safflower), *Helianthus annuus* (sunflower), *Nicotiana tabacum* (tobacco), *Arabidopsis thaliana, Betholettia excelsa* (Brazil nut), *Ricinus communis* (castor bean), *Cocos nucifera* (coconut), *Coriandrum sativum* (coriander), *Gossypium* spp. (cotton), *Arachis hypogaea* (groundnut or peanut), *Simmondsia chinensis* (jojoba), *Solanum tuberosum* (potato) *Elaeis guineensis* (oil palm), *Olea europaea* (olive), *Oryza sativa* (rice), *Cucurbita maxima* (squash), *Hordeum vulgare* (barley), and *Trificum aestivum* (wheat).

An aspect includes compositions comprising an effective amount of one or more of the dsRNAs provided in Table 1 for topical treatment of a plant to be treated for, or be protected from, flea beetle infestation. Another aspect includes a recombinant DNA construct encoding at least one strand of at least one the dsRNAs provided in Table 1 for transgenic expression in a plant that has improved resistance to flea beetle infestation, in comparison to a plant not expressing such a construct.

Example 2

This example illustrates non-limiting embodiments of testing the efficacy of dsRNA sequences and validating the dsRNA's utility for suppressing expression of target genes for controlling insect species. More specifically this example illustrates a method comprising contacting an insect, such as a flea beetle adult or larva, with one or more dsRNAs designed to cause stunting or mortality in the insect. Other embodiments include methods where the dsRNA is delivered to the insect by oral delivery (e. g., on or in a food material ingested by the insect), or through non-oral delivery (e. g., delivery through the insect's cuticle, or delivery by contacting an egg of the insect).

In one embodiment, a feeding assay is used to determine efficacy of a dsRNA in causing stunting or mortality in insects, such as flea beetles. To test the efficacy of the dsRNA to kill or stunt flea beetles, a single discriminating dose (for example, 100 nanograms/milliliter) is used to identify dsRNAs with measureable ability to kill or stunt flea beetles at that dose. A negative control dsRNA, such as a dsRNA targetting green fluorescent protein (GFP), is also included in the assay. Each dsRNA is coated evenly onto 1.0 centimeter diameter canola leaf discs and placed in multi-well trays, with 2 male and 2 female adult flea beetles or 4 flea beetle larvae per well. Every 24 hours for a set period (e. g., 2 weeks), new, freshly-coated leaves are provided. Stunting and mortality are scored periodically (e. g., daily, or every 2 or 3 days).

The dsRNAs that show efficacy in this single-dose assay are tested further. Using a similar protocol, varying doses of dsRNAs are tested, as described above, to determine the LC50 dose for each of the active dsRNAs. Bioassays include 12-24 insects per dose, performed in triplicate. Stunting and mortality is assessed over a 2 week period, scored on every third day.

The dsRNA sequences that are confirmed to be effective in suppressing a target gene in a sequence-specific manner are useful for identifying efficacious RNA delivery agents and formulations. The insecticidal activity of formulations containing dsRNA can be optimized by various techniques, such as modifying the chemical entities in the formulation or modifying the ratio of the chemical components in the formulation. Non-limiting examples of delivery agents and formulations are provided in Example 5.

Example 3

This example illustrates non-limiting embodiments of methods for validating dsRNA efficacy for suppressing or silencing a target gene in an insect cell or causing stunting or mortality in an insect. More specifically this example illustrates methods for testing dsRNA for efficacy in preventing or treating flea beetle infestations in whole plants.

Polynucleotides (such as the dsRNA sequences described in Examples 1 and 2) that have been confirmed to be effective in suppressing a target gene in a sequence-specific manner are further evaluated in whole plant assays. In one method, the polynucleotides (e. g., anti-sense RNA, dsRNA) are applied directly to the insect surface (e. g. by spraying or dusting). In another method, the polynucleotides are provided to the insect in an insect diet (e. g., in a bacterial or plant cell expressing a polynucleotide such as a hairpin form of a dsRNA, or in an artificial bait containing a polynucleotide). Stunting and mortality are scored periodically, as described in Example 2.

In various methods that are also appropriate for large-scale application (e. g., to fields of crop plants), the polynucleotide is applied in a foliar application through aerial or terrestrial spraying or dusting or chemigation on the leaf surface to control early season damage from the adult stage of the life cycle, or applied as a seed treatment to control larval or adult stages of the insect life cycle, or applied as a soil in-furrow or drench application to control larval or adult stages of the insect life cycle. An example of a foliar testing regime includes treating the plant immediately after emergence from the ground and evaluating foliar damage caused by adult flea beetles 1-2 weeks after plant emergence. For in-furrow or seed treatment similar timing for damage evaluation is followed.

Example 4

The polynucleotides are generally designed to modulate expression by inducing regulation or suppression of an insect target gene and are designed to have a nucleotide sequence essentially identical or essentially complementary to the nucleotide sequence an insect target gene or cDNA (e. g., SEQ ID NOs:1-859) or to the sequence of RNA transcribed from an insect target gene, which can be coding sequence or non-coding sequence. This example describes non-limiting techniques useful in the design and selection of polynucleotides to modulate expression of an insect target gene.

Selection of Effective Polynucleotides by "Tiling"

Polynucleotides of use in the compositions and methods disclosed herein need not be of the full length of a target gene, and in many embodiments are of much shorter length in comparison to the target gene. An example of a technique that is useful for selecting effective polynucleotides for insect control is "tiling", or evaluation of polynucleotides corresponding to adjacent or partially overlapping segments of a target gene.

Effective polynucleotides can be identified by "tiling" gene targets in selected length fragments, e. g., fragments of 200-300 nucleotides in length, with partially overlapping regions, e. g., of about 25 nucleotides, along the length of the target gene. To suppress a single gene, polynucleotides are designed to correspond to (have a nucleotide identity or complementarity with) regions that are unique to the target gene; the selected region of the target gene can include coding sequence or non-coding sequence (e. g., promoter regions, 3' untranslated regions, introns and the like) or a combination of both.

Where it is of interest to design a polynucleotide effective in suppressing multiple target genes, the multiple target gene sequences are aligned and polynucleotides designed to correspond to regions with high sequence homology in common among the multiple targets. Conversely, where it is of interest to design a polynucleotide effective in selectively suppressing one among multiple target sequences, the multiple target gene sequences are aligned and polynucleotides designed to correspond to regions with no or low sequence homology in common among the multiple targets.

In a non-limiting example, polynucleotides (e.g, anti-sense single-stranded RNAs, dsRNAs, anti-sense single-stranded DNAs, dsDNAs) capable of inducing suppression are designed for each of the target genes listed in Table 1 as follows. Multiple polynucleotides, each of 200-300 nucleotides in length and comprising a sequence complementary to a fragment of a target gene having a sequence selected from SEQ ID NOs:1-859 are designed so that each polynucleotide's sequence overlaps about 25 nucleotides of the next adjacent polynucleotide's sequence, in such a way that the multiple polynucleotides in combination cover the full length of the target gene. (Similarly, double-stranded polynucleotides can be designed by providing pairs of sense and anti-sense polynucleotides, each pair of polynucleotides overlapping the next adjacent pair of polynucleotides.)

The polynucleotides are tested by any convenient means for efficacy in silencing the insect target gene. Examples of a suitable test include the bioassays described herein in the working Examples. Another test involves the topical application of the polynucleotides either directly to individual insects or to the surface of a plant to be protected from an insect infestation. One desired result of treatment with a polynucleotide as disclosed herein is prevention or control of an insect infestation, e. g., by inducing in an insect a physiological or behavioural change such as, but not limited to, growth stunting, increased mortality, decrease in reproductive capacity, decrease in or cessation of feeding behavior or movement, or decrease in or cessation of metamorphosis stage development. Another desired result of treatment with a polynucleotide as disclosed herein is provision of a plant that exhibits improved resistance to an insect infestation.

The tiling procedure can be repeated, if desired. A polynucleotide found to provide desired activity can itself be subjected to a tiling procedure. For example, multiple overlapping polynucleotides are designed, each of 50-60 nucleotides in length and comprising a sequence complementary to the fragment of a target gene having a sequence selected from SEQ ID NOs:1-859 for which a single polynucleotide of 300 nucleotides was found to be effective. Additional rounds of tiling analysis can be carried out, where polynucleotides as short as 18, 19, 20, or 21 nucleotides are tested.

Effective polynucleotides of any size can be used, alone or in combination, in the various methods disclosed herein. In some embodiments, a single polynucleotide is used to make a composition (e. g., a composition for topical application, or a recombinant DNA construct useful for making a transgenic plant). In other embodiments, a mixture or pool of different polynucleotides is used; in such cases the polynucleotides can be for a single target gene or for multiple target genes. In some embodiments, a polynucleotide is designed to target different regions of the target gene, e. g., an insecticidal polynucleotide can comprise multiple segments that correspond to different exon regions of the target gene, and "spacer" nucleotides which do not correspond to a target gene can optionally be used in between or adjacent to the segments.

Thermodynamic Considerations in Selecting Insecticidal Polynucleotides

Polynucleotides can be designed or their sequence optimised using thermodynamic considerations. For example, insecticidal polynucleotides can be selected based on the thermodynamics controlling hybridization between one nucleic acid strand (e. g., a polynucleotide or an individual siRNA) and another (e. g., a target gene transcript)

Methods and algorithms to predict nucleotide sequences that are likely to be effective at RNAi-mediated silencing of a target gene are known in the art. Non-limiting examples of such methods and algorithms include "i-score", described by Ichihara et al. (2007) *Nucleic Acids Res.*, 35(18): 123e; "Oligowalk", publicly available at rna.urmc.rochester.edu/servers/oligowalk and described by Lu et al. (2008) *Nucleic Acids Res.*, 36:W104-108; and "Reynolds score", described by Khovorova et al. (2004) *Nature Biotechnol.*, 22:326-330.

Permitted Mismatches

By "essentially identical" or "essentially complementary" is meant that the polynucleotide (or at least one strand of a double-stranded polynucleotide) has sufficient identity or complementarity to the target gene or to the RNA transcribed from a target gene (e. g., the transcript) to suppress expression of a target gene (e. g., to effect a reduction in levels or activity of the target gene transcript and/or encoded protein). Polynucleotides need not have 100 percent identity or complementarity to a target gene or to the RNA transcribed from a target gene to suppress expression of the target gene (e. g., to effect a reduction in levels or activity of the target gene transcript or encoded protein, or to provide control of an insect species). In some embodiments, the polynucleotide or a portion thereof is designed to be essentially identical to, or essentially complementary to, a sequence of at least 18 or 19 contiguous nucleotides in either the target gene or the RNA transcribed from the target gene. In some embodiments, the polynucleotide or a portion thereof is designed to be exactly identical to, or exactly complementary to, a sequence of 21 contiguous nucleotides in either the target gene or the RNA transcribed from the target gene. In certain embodiments, an "essentially identical" polynucleotide has 100 percent sequence identity or at least about 83, 84, 85, 86, 87, 88, 89, 90, 91, 92, 93, 94, 95, 96, 97, 98, or 99 percent sequence identity when compared to the sequence of 18 or more contiguous nucleotides of the target gene or an RNA transcribed from the target gene. In certain embodiments, an "essentially complementary" polynucleotide has 100 percent sequence complementarity or at least about 83, 84, 85, 86, 87, 88, 89, 90, 91, 92, 93, 94, 95, 96, 97, 98, or 99 percent sequence complementarity to 18 or more contiguous nucleotides of the target gene or RNA transcribed from the target gene.

Polynucleotides comprising mismatches to the target gene or transcript can be used in certain embodiments of the compositions and methods disclosed herein. In some embodiments, the polynucleotide comprises at least 18 or at least 19 contiguous nucleotides that are essentially identical or essentially complementary to a segment of equivalent length in the target gene or target gene's transcript. In certain embodiments, a polynucleotide of 19 contiguous nucleotides that is essentially identical or essentially complementary to a segment of equivalent length in the target gene or target gene's transcript can have 1 or 2 mismatches to the target gene or transcript. In certain embodiments, a polynucleotide of 20 or more nucleotides that comprises a contiguous 19 nucleotide span of identity or complementarity to a segment of equivalent length in the target gene or target gene's transcript can have 1 or 2 mismatches to the target gene or transcript. In certain embodiments, a polynucleotide of 21 continuous nucleotides that is essentially identical or essentially complementary to a segment of equivalent length in the target gene or target gene's transcript can have 1, 2, or 3 mismatches to the target gene or transcript. In certain embodiments, a polynucleotide of 22 or more nucleotides that contains a contiguous 21 nucleotide span of identity or complementarity to a segment of equivalent length in the target gene or target gene's transcript can have 1, 2, or 3 mismatches to the target gene or transcript.

In designing polynucleotides with mismatches to a target gene or to an RNA transcribed from the target gene, mismatches of certain types and at certain positions that are more likely to be tolerated can be used. In certain embodiments, mismatches formed between adenine and cytosine or guanosine and uracil residues are used as described by Du et al. (2005) *Nucleic Acids Res.*, 33:1671-1677. In some embodiments, mismatches in 19 base-pair overlap regions are located at the low tolerance positions 5, 7, 8 or 11 (from the 5' end of a 19-nucleotide target), at medium tolerance positions 3, 4, and 12-17 (from the 5' end of a 19-nucleotide target), and/or at the high tolerance positions at either end of the region of complementarity, e. g., positions 1, 2, 18, and 19 (from the 5' end of a 19-nucleotide target) as described by Du et al. (2005) *Nucleic Acids Res.*, 33:1671-1677. Tolerated mismatches can be empirically determined in routine assays such as those described herein in the working Examples.

In some embodiments, the polynucleotides comprise additional nucleotides (e.g., for reasons of stability or for convenience in cloning or synthesis). In one embodiment, the polynucleotide is a single-stranded RNA comprising an RNA strand with a segment of at least 21 contiguous nucleotides of a sequence selected from the group consisting of SEQ ID NOs:860-1718 and 1722-1975 and further comprising an additional 5' G or an additional 3' C or both, adjacent to the segment. In one embodiment, the polynucleotide is a dsRNA comprising an RNA strand with a segment of at least 21 contiguous nucleotides of a sequence selected from the group consisting of SEQ ID NOs:860-1718 and 1722-1975 and further comprising an additional 5' G or an additional 3' C or both, adjacent to the segment. In another embodiment, the polynucleotide is a double-stranded RNA comprising additional nucleotides to form an overhang, for example, a dsRNA comprising 2 deoxyribonucleotides to form a 3' overhang.

Embedding Active Insecticidal Polynucleotides in Neutral Sequence

In an embodiment, a a polynucleotide with a sequence complementary to the target gene and which is responsible for an observed suppression of the target gene is embedded in "neutral" sequence, e. g., inserted into additional nucleotides that have no sequence identity or complementarity to the target gene. Neutral sequence can be desirable, e. g., to increase the overall length of a polynucleotide. For example, it can be desirable for a polynucleotide to be of a particular size for reasons of stability, cost-effectiveness in manufacturing, or biological activity.

It has been reported that in another coleopteran species, *Diabrotica virgifera*, dsRNAs greater than or equal to approximately 60 base-pairs (bp) are required for biological activity in artificial diet bioassays; see Bolognesi et al. (2012) PLoS ONE 7(10): e47534. doi:10.1371/journal.pone.0047534. Thus, in one embodiment, a 21-base-pair dsRNA corresponding to a target gene in Table 1 and found to provide control of an insect infestation is embedded in neutral sequence of an additional 39 base pairs, thus forming a polynucleotide of about 60 base pairs. In another embodiment, a single 21-base-pair polynucleotide is found to be efficacious when embedded in larger sections of neutral sequence, e. g., where the total polynucleotide length is from about 60 to about 300 base pairs. In another embodiment, at least one segment of at least 21 contiguous nucleotides of a sequence selected from the group consisting of SEQ ID NOs:860-1718 and 1722-1975 is embedded in larger sections of neutral sequence to provide an efficacious insecticidal polynucleotide. In another embodiment, segments from multiple sequences selected from the group consisting of SEQ ID NOs:860-1718 and 1722-1975 are embedded in larger sections of neutral sequence to provide an efficacious insecticidal polynucleotide.

It is anticipated that the combination of certain recombinant polynucleotides disclosed herein (e. g., single-strand RNA, dsRNA, single-strand DNA, or dsDNA comprising a sequence selected from SEQ ID NOs:860-1718 and 1722-1975, or active fragments thereof) with one or more non-polynucleotide pesticidal agents will result in an improvement in prevention or control of insect infestations, when compared to the effect obtained with the polynucleotide alone or the non-polynucleotide pesticidal agent alone. Routine insect bioassays such as the bioassays described herein in the working Examples are useful for defining dose-responses for larval mortality or growth inhibition using combinations of the polynucleotides disclosed herein and one or more non-polynucleotide pesticidal agents (e. g., a patatin, a plant lectin, a phytoecdy steroid, a *Bacillus thuringiensis* insecticidal protein, a *Xenorhabdus* insecticidal protein, a *Photorhabdus* insecticidal protein, a *Bacillus laterosporous* insecticidal protein, and a *Bacillus sphaericus* insecticidal protein). One of skill in the art can test combinations of polynucleotides and non-polynucleotide pesticidal agents in routine bioassays to identify combinations of bioactives that are effective for use in protecting plants from insect infestations.

Example 5

This example illustrates non-limiting embodiments of methods of testing the efficacy of insecticidal polynucleotides in flea beetles. More specifically this example illustrates a method including oral delivery of polynucleotides to flea beetles, resulting in stunting or mortality in the flea beetles.

*P. cruciferae* were collected from a canola field where no pesticides had been applied in the previous 3 months. Three dsRNAs (SEQ ID NOs:1169, 1193, and 1392) targeting *Phyllotreta* genes and one negative control dsRNA targeting GFP were tested on groups of 30 *P. cruciferae*. The dsRNAs were resuspended in water and applied to 6 millimeter leaf discs (55±6 milligrams each) at a discriminating dose of 50 nanograms dsRNA/milligram leaf tissue, which were fed to groups of 5 flea beetles. Leaf discs with freshly applied dsRNA were replaced every other day, and the number of surviving individuals was recorded over a 2-week period. A low non-specific mortality rate was observed in the negative-control insect groups (3 out of 30 insects dying over 2 weeks, or 10% non-specific mortality). Mortality was observed beginning at day 4 and continuing through the 2 week period. Specific mortality was observed for all dsRNA treatments (Table 2). Correcting for non-specific mortality (subtracting non-specific mortality rate of 3 insects per group for corrected N=27), the percent mortality observed at the end of the 2-week period was 85% (SEQ ID NO:1169), 0.70% (SEQ ID NO:1193), and 0.63% (SEQ ID NO:1392). These results demonstrated the efficacy of the dsRNAs in causing mortality in flea beetles when provided in the flea beetles' diet.

TABLE 2

Cumulative number of dead *P. cruciferae* (N = 30)

| Day | Negative control | SEQ ID NO: 1169 | SEQ ID NO: 1193 | SEQ ID NO: 1392 |
|---|---|---|---|---|
| 0 | 0 | 0 | 0 | 0 |
| 2 | 1 | 2 | 1 | 1 |
| 4 | 2 | 6 | 2 | 2 |
| 6 | 2 | 9 | 3 | 3 |
| 8 | 2 | 13 | 8 | 9 |
| 10 | 3 | 18 | 16 | 15 |
| 12 | 3 | 23 | 19 | 18 |
| 14 | 3 | 26 | 22 | 20 |

In a second series of experiments carried out in a similar manner, several dsRNAs were tested at a discriminating dose of 50 nanograms dsRNA/milligram leaf tissue on *P. cruciferae*; two lower doses (15 nanograms dsRNA/milligram leaf tissue and 2 nanograms dsRNA/milligram leaf tissue) were also tested. Ten beetles were tested at each dose. The negative control (five replicates) used was a dsRNA targetting the bacterial gene uidA encoding beta-glucuronidase (NCBI accession number NC_000913.3). Leaf discs with freshly applied dsRNA were replaced every other day, and mortality was recorded over a 12 day period. The overall mortality rate for the negative controls was ~4% (likely due to handling injuries) over the 12-day observation period. The observed cumulative mortality (N=10) following 12 days exposure to the dsRNAs are provided in Table 3; the negative control mortality values are given as an average (N=5). Eight of the dsRNAs (indicated by a mortality rating of +++) caused 90-100% mortality at the highest dose and were still highly effective (80% or higher mortality) at the lowest dose tested. Some dsRNAs (indicated by a mortality rating of ++) induced mortality in a proportion of the insects at the highest dose, but were less effective at lower doses (<20% mortality).

TABLE 3

| dsRNA SEQ ID NO**: | cumulative mortality (N = 10) | | | Mortality Rating* |
|---|---|---|---|---|
| | 50 ng/mg | 15 ng/mg | 2 ng/mg | |
| 870 | 3 | 1 | 0 | — |
| 876 | 3 | 1 | 0 | — |
| 1156 | 2 | 0 | 0 | — |
| 1157 | 10 | 3 | 0 | — |
| 1158 | 2 | 0 | 0 | — |
| 1159 | 5 | 2 | 0 | — |
| 1160 | 2 | 0 | 0 | — |
| 1161 | 10 | 3 | 1 | — |
| 1163 | 4 | 4 | 2 | — |
| 1164 | 10 | 8 | 4 | ++ |
| 1165 | 8 | 7 | 5 | ++ |
| 1166 | 5 | 2 | 2 | — |
| 1167 | 6 | 2 | 0 | — |
| 1168 | 8 | 5 | 0 | — |
| 1169 | 10 | 10 | 8 | +++ |
| 1170 | 9 | 5 | 3 | — |
| 1171 | 10 | 10 | 6 | ++ |
| 1392 | 3 | 2 | 0 | — |
| 1393 | 6 | 1 | 0 | — |
| 1186 | 9 | 7 | 5 | — |
| 1394 | 9 | 9 | 5 | — |
| 1187 | 9 | 9 | 8 | +++ |
| 1193 | 10 | 10 | 9 | +++ |
| 1210 | 6 | 3 | 1 | — |
| 1219 | 8 | 3 | 2 | — |
| 1224 | 10 | 9 | 8 | +++ |
| 1234 | 10 | 7 | 6 | ++ |
| 1243 | 5 | 2 | 0 | — |
| 1258 | 9 | 4 | 2 | — |
| 1396 | 9 | 6 | 5 | ++ |
| 1397 | 6 | 3 | 0 | — |
| 1398 | 8 | 7 | 7 | ++ |
| 1399 | 10 | 10 | 8 | +++ |
| 1400 | 2 | 1 | 1 | — |
| 1403 | 9 | 6 | 6 | — |
| 1404 | 10 | 7 | 4 | — |
| 1405 | 6 | 6 | 2 | — |
| 1406 | 9 | 9 | 7 | +++ |
| 1407 | 10 | 9 | 8 | +++ |
| 1408 | 9 | 9 | 9 | +++ |
| negative control (GFP) | 0.6 | 0.6 | 0.4 | — |
| negative control (beta-glucuronidase) | 0.4 | 0.6 | 0.2 | — |
| negative control (water only) | 0.2 | 0.4 | 0.6 | — |

*+++ rating indicates high (>80%) mortalities for all three doses;
++ rating indicates high mortalities for the highest dose, and within 40 to 70% mortality with the lower two doses.
** sequences are provided for the anti-sense strand of the dsRNA in 5' to 3' direction.

Other techniques for delivering these or similar insecticidal polynucleotides are contemplated and include applying the polynucleotides directly to the insect surface (e. g. by spraying or dusting), or providing the polynucleotides to the insect in a diet or bait (e. g., in a bacterial or plant cell expressing a dsRNA, or in an artificial bait containing the dsRNA). In an embodiment, a hairpin version of the *Phyllotreta* insecticidal polynucleotide with the sequence SEQ ID NO: 1169 is designed; this hairpin version is encoded by the DNA sequence SEQ ID NO:1722, which contains, in 5' to 3' order, anti-sense sequence (nucleotide positions 1-267), loop sequence (nucleotide positions 268-373) which does not contain matches to *Phyllotreta* sequences, and sense sequence (nucleotide positions 374-640). This DNA sequence is expressed as a single-stranded RNA transcript, where the anti-sense and sense regions anneal to form the double-stranded "stem" region of the hairpin. The construct is expressed in a bacterium, such as *E. coli*; the resulting dsRNA hairpin produced in the bacterium is provided to flea beetles as a crude or purified fermentation product, or in the form of the bacterial cells. Similar constructs are designed encoding dsRNAs having modified stem-loops, such as "stabilized anti-sense" or "stabilized sense" versions, which contain stabilized loops formed by an extended anti-sense or sense sequence, respectively, of sequence corresponding to the intended target gene.

Example 6

This example discloses embodiments related to polynucleotide molecules having a nucleotide sequence containing specific modifications such as nucleotide substitutions. Embodiments of such modifications include modified polynucleotides that provide improved sequence discrimination between the intended target gene of the insect pest of interest, and genetic sequences of other, non-target species.

Selected dsRNAs identified in Table 1 were screened for unintended sequence matches to a sequence of at least 19 contiguous nucleotides identified in a non-target gene or a non-target organism (NTO, e. g., *Apis mellifera, Bombus impatiens* and *B. terrestris; Coleomegilla* spp.; *Danaus plexippus; Homo sapiens; Megachile rotundata; Mus musculus*; and *Brassica rapa*). Nucleotide changes are made in an original polynucleotide sequence to eliminate contiguous sequence matches to a non-target gene or non-target organism. Examples of such modified polynucleotide sequences are provided by SEQ ID NO:1723, which corresponds to SEQ ID NO:1393 (which targets the same flea beetle gene as does the insecticidal polynucleotide of SEQ ID NO:1392), and SEQ ID NO:1724, which corresponds to SEQ ID NO:1169.

Example 7

This example discloses embodiments related to polynucleotide molecules having a nucleotide sequence for silencing a target gene in more than one species. Embodiments include dsRNA sequences of at least 21 contiguous nucleotides identified as having 100% complementarity or identity to more than one ortholog of a target gene.

Table 4 provides a list of sequences, each at least 21 contiguous nucleotides in length and identified by the sequence's coordinates in a dsRNA for one flea beetle species, wherein the identical sequence is also found in a dsRNA for a different flea beetle species. These sequences are useful to design insecticidal polynucleotides against multiple species in which the target sequence co-occurs. For example, SEQ ID NO:1186 (targetting a *Phyllotreta cruciferae* COPI alpha target gene, SEQ ID NO:327) contains five sequences of at least 21 contiguous nucleotides at positions 1-71, 88-116, 136-209, 238-266, and 274-296, all of which match a sequence in SEQ ID NOs:882 and 888 (targetting a *Phyllotreta atra* COPI alpha target genes, SEQ ID NOs:23 and 29, respectively); these five sequences are therefore useful in targeting a gene in the two *Phyllotreta* species.

TABLE 4

| QUERY Polynucleotide SEQ ID NO: | start | end | SUBJECT Polynucleotide SEQ ID NO: | QUERY Polynucleotide SEQ ID NO: | start | end | SUBJECT Polynucleotide SEQ ID NO: |
|---|---|---|---|---|---|---|---|
| 1186 | 1 | 71 | 882, 888 | 1333 | 329 | 351 | 1039-1043, 1045, 1594, 1597, 1598 |
| 1186 | 88 | 116 | 882, 888 | 1334 | 42 | 98 | 1039-1043, 1045, 1594, 1597, 1598 |
| 1186 | 136 | 209 | 882, 888 | 1334 | 109 | 185 | 1039-1043, 1045, 1594, 1597, 1598 |
| 1186 | 238 | 266 | 882, 888 | 1334 | 187 | 254 | 1039-1043, 1045, 1594, 1597, 1598 |
| 1186 | 274 | 296 | 882, 888 | 1334 | 271 | 302 | 1039-1043, 1045, 1594, 1597, 1598 |
| 1191 | 51 | 96 | 900-908, 910 | 1335 | 2 | 47 | 1039-1043, 1045, 1594, 1597, 1598 |
| 1191 | 137 | 177 | 900-908, 910 | 1335 | 49 | 116 | 1039-1043, 1045, 1594, 1597, 1598 |
| 1191 | 179 | 216 | 900-908, 910 | 1335 | 133 | 164 | 1039-1043, 1045, 1594, 1597, 1598 |
| 1191 | 218 | 255 | 900-908, 910 | 1335 | 229 | 251 | 1039-1043, 1045, 1594, 1597, 1598 |
| 1191 | 257 | 342 | 900-908, 910 | 1336 | 34 | 90 | 1039-1043, 1045, 1594, 1597, 1598 |
| 1192 | 2 | 25 | 900-908, 910 | 1336 | 101 | 177 | 1039-1043, 1045, 1594, 1597, 1598 |
| 1192 | 66 | 106 | 900-908, 910 | 1336 | 179 | 246 | 1039-1043, 1045, 1594, 1597, 1598 |
| 1192 | 108 | 145 | 900-908, 910 | 1336 | 263 | 294 | 1039-1043, 1045, 1594, 1597, 1598 |
| 1192 | 147 | 184 | 900-908, 910 | 1338 | 40 | 96 | 1039-1043, 1045, 1594, 1597, 1598 |
| 1192 | 186 | 271 | 900-908, 910 | 1338 | 107 | 183 | 1039-1043, 1045, 1594, 1597, 1598 |
| 1192 | 273 | 298 | 900-908, 910 | 1338 | 185 | 252 | 1039-1043, 1045, 1594, 1597, 1598 |
| 1192 | 300 | 330 | 900-908, 910 | 1338 | 269 | 300 | 1039-1043, 1045, 1594, 1597, 1598 |
| 1191 | 58 | 96 | 900-908, 910 | 1328 | 35 | 59 | 1039-1043, 1045, 1594, 1597, 1598 |
| 1192 | 300 | 336 | 900-908, 910 | 1331 | 60 | 84 | 1039-1043, 1045, 1594, 1597, 1598 |
| 1191 | 44 | 96 | 900-908, 910 | 1332 | 1 | 26 | 1039-1043, 1045, 1594, 1597, 1598 |
| 1191 | 179 | 200 | 900-908, 910 | 1333 | 36 | 60 | 1039-1043, 1045, 1594, 1597, 1598 |
| 1192 | 108 | 129 | 900-908, 910 | 1334 | 74 | 98 | 1039-1043, 1045, 1594, 1597, 1598 |
| 1191 | 218 | 242 | 900-908, 910 | 1336 | 66 | 90 | 1039-1043, 1045, 1594, 1597, 1598 |
| 1192 | 147 | 171 | 900-908, 910 | 1338 | 72 | 96 | 1039-1043, 1045, 1594, 1597, 1598 |
| 1191 | 257 | 277 | 900-908, 910 | 1331 | 1 | 26 | 1039-1043, 1045, 1594, 1597, 1598 |
| 1192 | 186 | 206 | 900-908, 910 | 1334 | 2 | 40 | 1039-1043, 1045, 1594, 1597, 1598 |
| 1191 | 257 | 334 | 900-908, 910 | 1336 | 2 | 32 | 1039-1043, 1045, 1594,1597, 1598 |
| 1192 | 186 | 263 | 900-908, 910 | 1338 | 2 | 38 | 1039-1043, 1045, 1594, 1597, 1598 |
| 1191 | 257 | 320 | 900-908, 910 | 1328 | 36 | 59 | 1039-1043, 1045, 1594, 1597, 1598 |
| 1192 | 186 | 249 | 900-908, 910 | 1331 | 61 | 84 | 1039-1043, 1045, 1594, 1597, 1598 |
| 1193 | 15 | 101 | 911, 915, 916, 919 | 1332 | 3 | 26 | 1039-1043, 1045, 1594,1597, 1598 |
| 1194 | 6 | 92 | 911, 915, 916, 919 | 1333 | 37 | 60 | 1039-1043, 1045, 1594, 1597, 1598 |
| 1195 | 2 | 107 | 911, 915, 916, 919 | 1334 | 75 | 98 | 1039-1043, 1045, 1594, 1597, 1598 |
| 1195 | 121 | 207 | 911, 915, 916, 919 | 1336 | 67 | 90 | 1039-1043, 1045, 1594, 1597, 1598 |
| 1196 | 2 | 122 | 911, 915, 916, 919 | 1338 | 73 | 96 | 1039-1043, 1045, 1594, 1597, 1598 |
| 1196 | 136 | 222 | 911, 915, 916, 919 | 1329 | 172 | 191 | 1039-1043 1045 |
| 1197 | 2 | 20 | 911, 915, 916, 919 | 1329 | 265 | 296 | 1039-1043 1045 |
| 1197 | 22 | 42 | 911, 915, 916, 919 | 1329 | 298 | 317 | 1039-1043 1045 |
| 1197 | 44 | 180 | 911, 915, 916, 919 | 1329 | 319 | 343 | 1039-1043 1045 |
| 1197 | 194 | 280 | 911, 915, 916, 919 | 1330 | 181 | 200 | 1039-1043 1045 |
| 1198 | 18 | 38 | 911, 915, 916, 919 | 1330 | 274 | 305 | 1039-1043 1045 |
| 1198 | 40 | 176 | 911, 915, 916, 919 | 1330 | 307 | 326 | 1039-1043 1045 |
| 1198 | 190 | 276 | 911, 915, 916, 919 | 1330 | 328 | 352 | 1039-1043 1045 |
| 1199 | 5 | 25 | 911, 915, 916, 919 | 1335 | 283 | 302 | 1039-1043, 1045, 1594, 1597, 1598 |
| 1199 | 27 | 163 | 911, 915, 916, 919 | 1337 | 1 | 19 | 1043, 1045 |
| 1199 | 177 | 263 | 911, 915, 916, 919 | 1337 | 93 | 124 | 1043, 1045 |
| 1200 | 16 | 152 | 911, 915, 916, 919 | 1337 | 126 | 145 | 1043, 1045 |
| 1200 | 166 | 252 | 911, 915, 916, 919 | 1337 | 147 | 171 | 1043, 1045 |
| 1201 | 19 | 105 | 911, 915, 916, 919 | 1329 | 319 | 352 | 1039-1043 1045 |
| 1202 | 2 | 119 | 911, 915, 916, 919 | 1337 | 147 | 180 | 1043, 1045 |
| 1202 | 133 | 219 | 911, 915, 916, 919 | 1386 | 2 | 38 | 1054-1057, 1060, 1496, 1498 |
| 1203 | 14 | 100 | 911, 915, 916, 919 | 1386 | 40 | 59 | 1054-1057, 1060, 1496, 1498 |
| 1193 | 123 | 189 | 911, 915, 916, 919 | 1386 | 70 | 95 | 1054-1057, 1060, 1496, 1498 |
| 1194 | 114 | 180 | 911, 915, 916, 919 | 1386 | 103 | 161 | 1054-1057, 1060, 1496, 1498 |
| 1195 | 229 | 295 | 911, 915, 916, 919 | 1386 | 196 | 262 | 1054-1057, 1060, 1496, 1498 |
| 1196 | 244 | 310 | 911, 915, 916, 919 | 1388 | 2 | 51 | 1054-1057, 1060, 1496, 1498 |
| 1197 | 302 | 350 | 911, 915, 916, 919 | 1388 | 53 | 72 | 1054-1057, 1060, 1496, 1498 |
| 1198 | 298 | 350 | 911, 915, 916, 919 | 1388 | 83 | 108 | 1054-1057, 1060, 1496, 1498 |
| 1199 | 285 | 352 | 911, 915, 916, 919 | 1388 | 116 | 174 | 1054-1057, 1060, 1496, 1498 |
| 1200 | 274 | 340 | 911, 915, 916, 919 | 1388 | 209 | 275 | 1054-1057, 1060, 1496, 1498 |
| 1201 | 127 | 193 | 911, 915, 916, 919 | 1390 | 88 | 119 | 1054-1057, 1060, 1492, 1496-1498 |
| 1202 | 241 | 307 | 911, 915, 916, 919 | 1390 | 145 | 194 | 1054-1057, 1060, 1492, 1496-1498 |
| 1203 | 122 | 188 | 911, 915, 916, 919 | 1390 | 196 | 215 | 1054-1057, 1060, 1492, 1496-1498 |
| 1193 | 123 | 196 | 911, 915, 916, 919 | 1390 | 226 | 251 | 1054-1057, 1060, 1492, 1496-1498 |
| 1193 | 198 | 230 | 911, 915, 916, 919 | 1390 | 259 | 317 | 1054-1057, 1060, 1492, 1496-1498 |
| 1194 | 114 | 187 | 911, 915, 916, 919 | 1391 | 19 | 50 | 1054-1057, 1060, 1492, 1496-1498 |
| 1194 | 189 | 221 | 911, 915, 916, 919 | 1391 | 76 | 125 | 1054-1057, 1060, 1492, 1496-1498 |
| 1195 | 229 | 302 | 911, 915, 916, 919 | 1391 | 127 | 146 | 1054-1057, 1060, 1492, 1496-1498 |
| 1195 | 304 | 336 | 911, 915, 916, 919 | 1391 | 157 | 182 | 1054-1057, 1060, 1492, 1496-1498 |
| 1196 | 1 | 122 | 911, 915, 916, 919 | 1391 | 190 | 248 | 1054-1057, 1060, 1492, 1496-1498 |
| 1196 | 244 | 317 | 911, 915, 916, 919 | 1391 | 283 | 349 | 1054-1057, 1060, 1492, 1496-1498 |
| 1196 | 319 | 351 | 911, 915, 916, 919 | 1384 | 20 | 39 | 1055, 1058, 1059, 1061-1063, 1500 |
| 1197 | 60 | 180 | 911, 915, 916, 919 | 1384 | 62 | 84 | 1055, 1058, 1059, 1061-1063, 1500 |

TABLE 4-continued

| QUERY Polynucleotide SEQ ID NO: | start | end | SUBJECT Polynucleotide SEQ ID NO: | QUERY Polynucleotide SEQ ID NO: | start | end | SUBJECT Polynucleotide SEQ ID NO: |
|---|---|---|---|---|---|---|---|
| 1198 | 56 | 176 | 911, 915, 916, 919 | 1384 | 134 | 204 | 1055, 1058, 1059, 1061-1063, 1500 |
| 1199 | 43 | 163 | 911, 915, 916, 919 | 1384 | 206 | 249 | 1055, 1058, 1059, 1061-1063, 1500 |
| 1199 | 285 | 351 | 911, 915, 916, 919 | 1384 | 251 | 270 | 1055, 1058, 1059, 1061-1063, 1500 |
| 1200 | 32 | 152 | 911, 915, 916, 919 | 1384 | 284 | 305 | 1055, 1058, 1059, 1061-1063, 1500 |
| 1200 | 274 | 347 | 911, 915, 916, 919 | 1385 | 21 | 40 | 1055, 1058, 1059, 1061-1063, 1500 |
| 1201 | 127 | 200 | 911, 915, 916, 919 | 1385 | 63 | 85 | 1055, 1058, 1059, 1061-1063, 1500 |
| 1201 | 202 | 234 | 911, 915, 916, 919 | 1385 | 135 | 205 | 1055, 1058, 1059, 1061-1063, 1500 |
| 1202 | 241 | 314 | 911, 915, 916, 919 | 1385 | 207 | 250 | 1055, 1058, 1059, 1061-1063, 1500 |
| 1202 | 316 | 348 | 911, 915, 916, 919 | 1385 | 252 | 271 | 1055, 1058, 1059, 1061-1063, 1500 |
| 1203 | 122 | 195 | 911, 915, 916, 919 | 1385 | 285 | 306 | 1055, 1058, 1059, 1061-1063, 1500 |
| 1203 | 197 | 229 | 911, 915, 916, 919 | 1387 | 2 | 21 | 1055, 1058, 1059, 1061-1063, 1500, 1057 |
| 1204 | 6 | 25 | 920, 921, 922, 923, 924 | 1387 | 23 | 42 | 1055, 1058, 1059, 1061-1063, 1500, 1057 |
| 1204 | 27 | 49 | 920, 921, 922, 923, 924 | 1387 | 56 | 77 | 1055, 1058, 1059, 1061-1063, 1500, 1057 |
| 1204 | 51 | 118 | 920, 921, 922, 923, 924 | 1389 | 1 | 55 | 1055, 1058, 1059, 1061-1063, 1500 |
| 1204 | 186 | 214 | 920, 921, 922, 923, 924 | 1389 | 57 | 100 | 1055, 1058, 1059, 1061-1063, 1500 |
| 1204 | 219 | 268 | 920, 921, 922, 923, 924 | 1389 | 102 | 121 | 1055, 1058, 1059, 1061-1063, 1500 |
| 1204 | 270 | 295 | 920, 921, 922, 923, 924 | 1389 | 135 | 156 | 1055, 1058, 1059, 1061-1063, 1500 |
| 1204 | 306 | 351 | 920, 921, 922, 923, 924 | 1386 | 196 | 255 | 1054-1057, 1060, 1496, 1498 |
| 1205 | 180 | 199 | 920, 921, 922, 923, 924 | 1388 | 209 | 268 | 1054-1057, 1060, 1496, 1498 |
| 1205 | 201 | 223 | 920, 921, 922, 923, 924 | 1391 | 283 | 342 | 1054-1057, 1060, 1492, 1496-1498 |
| 1205 | 225 | 292 | 920, 921, 922, 923, 924 | 1387 | 257 | 321 | 1055, 1058, 1059, 1061-1063, 1500, 1057 |
| 1206 | 10 | 29 | 920, 921, 922, 923, 924 | 1387 | 332 | 351 | 1055, 1058, 1059, 1061-1063, 1500, 1057 |
| 1206 | 31 | 53 | 920, 921, 922, 923, 924 | 1390 | 25 | 56 | 1054-1057, 1060, 1492, 1496-1498 |
| 1206 | 55 | 122 | 920, 921, 922, 923, 924 | 1384 | 284 | 321 | 1055, 1058, 1059, 1061-1063, 1500 |
| 1206 | 190 | 218 | 920, 921, 922, 923, 924 | 1385 | 285 | 322 | 1055, 1058, 1059, 1061-1063, 1500 |
| 1206 | 223 | 272 | 920, 921, 922, 923, 924 | 1387 | 56 | 93 | 1055, 1058, 1059, 1061-1063, 1500, 1057 |
| 1206 | 274 | 299 | 920, 921, 922, 923, 924 | 1389 | 135 | 172 | 1055, 1058, 1059, 1061-1063, 1500 |
| 1206 | 310 | 351 | 920, 921, 922, 923, 924 | 1386 | 196 | 332 | 1054-1057, 1060, 1496, 1498 |
| 1207 | 11 | 33 | 920, 921, 922, 923, 924 | 1388 | 209 | 345 | 1054-1057, 1060, 1496, 1498 |
| 1207 | 35 | 102 | 920, 921, 922, 923, 924 | 1391 | 283 | 352 | 1054-1057, 1060, 1492, 1496-1498 |
| 1207 | 170 | 198 | 920, 921, 922, 923, 924 | 1384 | 323 | 348 | 1055, 1058, 1059, 1061-1063, 1500 |
| 1207 | 203 | 252 | 920, 921, 922, 923, 924 | 1385 | 324 | 349 | 1055, 1058, 1059, 1061-1063, 1500 |
| 1207 | 254 | 279 | 920, 921, 922, 923, 924 | 1387 | 95 | 120 | 1055, 1058, 1059, 1061-1063, 1500, 1057 |
| 1207 | 290 | 335 | 920, 921, 922, 923, 924 | 1387 | 128 | 153 | 1055, 1058, 1059, 1061-1063, 1500, 1057 |
| 1208 | 18 | 40 | 920, 921, 922, 923, 924 | 1387 | 161 | 186 | 1055, 1058, 1059, 1061-1063, 1500, 1057 |
| 1208 | 42 | 109 | 920, 921, 922, 923, 924 | 1387 | 191 | 210 | 1055, 1058, 1059, 1061-1063, 1500, 1057 |
| 1208 | 177 | 205 | 920, 921, 922, 923, 924 | 1389 | 174 | 199 | 1055, 1058, 1059, 1061-1063, 1500 |
| 1208 | 210 | 259 | 920, 921, 922, 923, 924 | 1389 | 207 | 232 | 1055, 1058, 1059, 1061-1063, 1500 |
| 1208 | 261 | 286 | 920, 921, 922, 923, 924 | 1389 | 240 | 265 | 1055, 1058, 1059, 1061-1063, 1500 |
| 1208 | 297 | 342 | 920, 921, 922, 923, 924 | 1389 | 270 | 289 | 1055, 1058, 1059, 1061-1063, 1500 |
| 1209 | 101 | 120 | 920, 921, 922, 923, 924 | 1283 | 177 | 208 | 1064-1070 |
| 1209 | 122 | 144 | 920, 921, 922, 923, 924 | 1284 | 130 | 161 | 1064-1070 |
| 1209 | 146 | 213 | 920, 921, 922, 923, 924 | 1284 | 301 | 351 | 1064-1070 |
| 1209 | 281 | 309 | 920, 921, 922, 923, 924 | 1286 | 210 | 241 | 1064-1070 |
| 1209 | 314 | 351 | 920, 921, 922, 923, 924 | 1287 | 126 | 157 | 1064-1070 |
| 1205 | 2 | 91 | 920, 921, 922, 923, 924 | 1287 | 297 | 351 | 1064-1070 |
| 1205 | 114 | 142 | 920, 921, 922, 923, 924 | 1288 | 326 | 351 | 1064-1070, 1071 |
| 1205 | 144 | 178 | 920, 921, 922, 923, 924 | 1289 | 41 | 72 | 1064-1070 |
| 1209 | 35 | 63 | 920, 921, 922, 923, 924 | 1289 | 212 | 288 | 1064-1070 |
| 1209 | 65 | 99 | 920, 921, 922, 923, 924 | 1289 | 320 | 351 | 1064-1070 |
| 1204 | 306 | 347 | 920, 921, 922, 923, 924 | 1290 | 178 | 209 | 1064-1070 |
| 1207 | 290 | 331 | 920, 921, 922, 923, 924 | 1291 | 228 | 259 | 1064-1070, 1071 |
| 1208 | 297 | 338 | 920, 921, 922, 923, 924 | 1292 | 43 | 74 | 1064-1070 |
| 1207 | 290 | 352 | 920, 921, 922, 923, 924 | 1292 | 214 | 290 | 1064-1070 |
| 1208 | 297 | 351 | 920, 921, 922, 923, 924 | 1292 | 322 | 351 | 1064-1070 |
| 1205 | 18 | 91 | 920, 921, 922, 923, 924 | 1293 | 330 | 351 | 1064-1070, 1071 |
| 1224 | 1 | 43 | 947-949, 951-956 | 1377 | 37 | 68 | 1064-1070 |
| 1224 | 57 | 95 | 947-949, 951-956 | 1377 | 208 | 284 | 1064-1070 |
| 1224 | 97 | 145 | 947-949, 951-956 | 1377 | 316 | 348 | 1064-1070 |
| 1224 | 147 | 175 | 947-949, 951-956 | 1289 | 212 | 274 | 1064-1070 |
| 1224 | 177 | 208 | 947-949, 951-956 | 1292 | 214 | 276 | 1064-1070 |
| 1224 | 210 | 262 | 947-949, 951-956 | 1377 | 208 | 270 | 1064-1070 |
| 1224 | 285 | 350 | 947-949, 951-956 | 1285 | 123 | 148 | 1067, 1069, 1071 |
| 1225 | 150 | 192 | 947, 949, 951-956 | 1288 | 107 | 132 | 1064-1070, 1071 |
| 1225 | 206 | 244 | 947, 949, 951-956 | 1291 | 9 | 34 | 1064-1070, 1071 |
| 1225 | 246 | 294 | 947, 949, 951-956 | 1293 | 111 | 136 | 1064-1070, 1071 |
| 1225 | 296 | 324 | 947, 949, 951-956 | 1287 | 297 | 347 | 1064-1070 |
| 1225 | 326 | 351 | 947, 949, 951-956 | 1289 | 212 | 262 | 1064-1070 |
| 1226 | 258 | 300 | 947, 949, 951-955 | 1292 | 214 | 264 | 1064-1070 |
| 1226 | 314 | 351 | 947, 949, 951-955 | 1377 | 208 | 258 | 1064-1070 |
| 1227 | 253 | 295 | 947, 949, 951-955 | 1287 | 297 | 352 | 1064-1070 |
| 1227 | 309 | 347 | 947, 949, 951-955 | 1289 | 212 | 266 | 1064-1070 |
| 1228 | 206 | 248 | 947, 949, 951-955 | 1292 | 214 | 268 | 1064-1070 |

TABLE 4-continued

| QUERY Polynucleotide SEQ ID NO: | start | end | SUBJECT Polynucleotide SEQ ID NO: | QUERY Polynucleotide SEQ ID NO: | start | end | SUBJECT Polynucleotide SEQ ID NO: |
|---|---|---|---|---|---|---|---|
| 1228 | 262 | 300 | 947, 949, 951-956 | 1377 | 208 | 262 | 1064-1070 |
| 1228 | 302 | 350 | 947, 949, 951-956 | 1285 | 18 | 61 | 1067, 1069, 1071 |
| 1229 | 171 | 213 | 947, 949, 951-956 | 1288 | 2 | 45 | 1064-1070, 1071 |
| 1229 | 227 | 265 | 947, 949, 951-956 | 1293 | 6 | 49 | 1064-1070, 1071 |
| 1229 | 267 | 315 | 947, 949, 951-956 | 1357 | 1 | 40 | 1079-1082, 1152-1154, 1455, 1457, 1458 |
| 1229 | 317 | 345 | 947, 949, 951-956 | 1357 | 63 | 85 | 1079-1082, 1152-1154, 1455, 1457, 1458 |
| 1230 | 252 | 294 | 947, 949, 951-955 | 1357 | 102 | 157 | 1079-1082, 1152-1154, 1455, 1457, 1458 |
| 1230 | 308 | 346 | 947, 949, 951-955 | 1357 | 159 | 189 | 1079-1082, 1152-1154, 1455, 1457, 1458 |
| 1231 | 191 | 233 | 947, 949, 951-956 | 1357 | 191 | 322 | 1079-1082, 1152-1154, 1455, 1457, 1458 |
| 1231 | 247 | 285 | 947, 949, 951-956 | 1358 | 25 | 47 | 1079-1082, 1152-1154, 1455, 1457, 1458 |
| 1231 | 287 | 335 | 947, 949, 951-956 | 1358 | 64 | 119 | 1079-1082, 1152-1154, 1455, 1457, 1458 |
| 1232 | 196 | 238 | 947, 949, 951-956 | 1358 | 121 | 151 | 1079-1082, 1152-1154, 1455, 1457, 1458 |
| 1232 | 252 | 290 | 947, 949, 951-956 | 1358 | 153 | 284 | 1079-1082, 1152-1154, 1455, 1457, 1458 |
| 1232 | 292 | 340 | 947, 949, 951-956 | 1359 | 31 | 53 | 1079-1082, 1152-1154, 1455, 1457, 1458 |
| 1233 | 209 | 251 | 947, 949, 951-956 | 1359 | 70 | 125 | 1079-1082, 1152-1154, 1455, 1457, 1458 |
| 1233 | 265 | 303 | 947, 949, 951-956 | 1359 | 127 | 157 | 1079-1082, 1152-1154, 1455, 1457, 1458 |
| 1233 | 305 | 351 | 947, 949, 951-956 | 1359 | 159 | 290 | 1079-1082, 1152-1154, 1455, 1457, 1458 |
| 1224 | 177 | 202 | 947-949, 951-956 | 1360 | 38 | 60 | 1079-1082, 1152-1154, 1455, 1457, 1458 |
| 1225 | 1 | 72 | 947, 949, 951-956 | 1360 | 77 | 132 | 1079-1082, 1152-1154, 1455, 1457, 1458 |
| 1225 | 74 | 135 | 947, 949, 951-956 | 1360 | 134 | 164 | 1079-1082, 1152-1154, 1455, 1457, 1458 |
| 1225 | 137 | 192 | 947, 949, 951-956 | 1360 | 166 | 297 | 1079-1082, 1152-1154, 1455, 1457, 1458 |
| 1226 | 110 | 180 | 947, 949, 951-955 | 1361 | 1 | 41 | 1079-1082, 1152-1154, 1455, 1457, 1458 |
| 1226 | 182 | 243 | 947, 949, 951-955 | 1361 | 64 | 86 | 1079-1082, 1152-1154, 1455, 1457, 1458 |
| 1226 | 245 | 300 | 947, 949, 951-955 | 1361 | 103 | 158 | 1079-1082, 1152-1154, 1455, 1457, 1458 |
| 1227 | 105 | 175 | 947, 949, 951-955 | 1361 | 160 | 190 | 1079-1082, 1152-1154, 1455, 1457, 1458 |
| 1227 | 177 | 238 | 947, 949, 951-955 | 1361 | 192 | 323 | 1079-1082, 1152-1154, 1455, 1457, 1458 |
| 1227 | 240 | 295 | 947, 949, 951-955 | 1362 | 31 | 53 | 1079-1082, 1152-1154, 1455, 1457, 1458 |
| 1228 | 58 | 128 | 947, 949, 951-956 | 1362 | 70 | 125 | 1079-1082, 1152-1154, 1455, 1457, 1458 |
| 1228 | 130 | 191 | 947, 949, 951-956 | 1362 | 127 | 157 | 1079-1082, 1152-1154, 1455, 1457, 1458 |
| 1228 | 193 | 248 | 947, 949, 951-956 | 1362 | 159 | 290 | 1079-1082, 1152-1154, 1455, 1457, 1458 |
| 1229 | 23 | 93 | 947, 949, 951-956 | 1363 | 33 | 55 | 1079-1082, 1152-1154, 1455, 1457, 1458 |
| 1229 | 95 | 156 | 947, 949, 951-956 | 1363 | 72 | 127 | 1079-1082, 1152-1154, 1455, 1457, 1458 |
| 1229 | 158 | 213 | 947, 949, 951-956 | 1363 | 129 | 159 | 1079-1082, 1152-1154, 1455, 1457, 1458 |
| 1230 | 104 | 174 | 947, 949, 951-955 | 1363 | 161 | 292 | 1079-1082, 1152-1154, 1455, 1457, 1458 |
| 1230 | 176 | 237 | 947, 949, 951-955 | 1364 | 4 | 59 | 1079-1082, 1152-1154, 1455, 1457, 1458 |
| 1230 | 239 | 294 | 947, 949, 951-955 | 1364 | 61 | 91 | 1079-1082, 1152-1154, 1455, 1457, 1458 |
| 1231 | 43 | 113 | 947, 949, 951-956 | 1364 | 93 | 224 | 1079-1082, 1152-1154, 1455, 1457, 1458 |
| 1231 | 115 | 176 | 947, 949, 951-956 | 1365 | 35 | 57 | 1079-1082, 1152-1154, 1455, 1457, 1458 |
| 1231 | 178 | 233 | 947, 949, 951-956 | 1365 | 74 | 129 | 1079-1082, 1152-1154, 1455, 1457, 1458 |
| 1232 | 48 | 118 | 947, 949, 951-956 | 1365 | 131 | 161 | 1079-1082, 1152-1154, 1455, 1457, 1458 |
| 1232 | 120 | 181 | 947, 949, 951-956 | 1365 | 163 | 294 | 1079-1082, 1152-1154, 1455, 1457, 1458 |
| 1232 | 183 | 238 | 947, 949, 951-956 | 1366 | 2 | 26 | 1079-1082, 1152-1154, 1455, 1457, 1458 |
| 1233 | 61 | 131 | 947, 949, 951-956 | 1366 | 28 | 58 | 1079-1082, 1152-1154, 1455, 1457, 1458 |
| 1233 | 133 | 194 | 947, 949, 951-956 | 1366 | 60 | 191 | 1079-1082, 1152-1154, 1455, 1457, 1458 |
| 1233 | 196 | 251 | 947, 949, 951-956 | 1367 | 2 | 116 | 1079, 1080, 1081, 1082, 1152, 1153, 1154 |
| 1224 | 227 | 262 | 947-949, 951-956 | 1358 | 322 | 345 | 1079-1082, 1152-1154, 1455, 1457, 1458 |
| 1224 | 57 | 94 | 947-949, 951-956 | 1359 | 328 | 350 | 1079-1082, 1152-1154, 1455, 1457, 1458 |
| 1225 | 2 | 72 | 947, 949, 951-956 | 1362 | 328 | 351 | 1079-1082, 1152-1154, 1455, 1457, 1458 |
| 1225 | 206 | 243 | 947, 949, 951-956 | 1363 | 330 | 352 | 1079-1082, 1152-1154, 1455, 1457, 1458 |
| 1226 | 1 | 96 | 947, 949, 951-955 | 1364 | 262 | 285 | 1079-1082, 1152-1154, 1455, 1457, 1458 |
| 1226 | 98 | 180 | 947, 949, 951-955 | 1365 | 332 | 351 | 1079-1082, 1152-1154, 1455, 1457, 1458 |
| 1227 | 2 | 91 | 947, 949, 951-955 | 1366 | 229 | 252 | 1079-1082, 1152-1154, 1455, 1457, 1458 |
| 1227 | 93 | 175 | 947, 949, 951-955 | 1367 | 154 | 177 | 1079-1082, 1152-1154 |
| 1227 | 309 | 346 | 947, 949, 951-955 | 1358 | 322 | 344 | 1079-1082, 1152-1154, 1455, 1457, 1458 |
| 1228 | 2 | 44 | 947, 949, 951-956 | 1362 | 328 | 350 | 1079-1082, 1152-1154, 1455, 1457, 1458 |
| 1228 | 46 | 128 | 947, 949, 951-956 | 1364 | 262 | 284 | 1079-1082, 1152-1154, 1455, 1457, 1458 |
| 1228 | 262 | 299 | 947, 949, 951-956 | 1366 | 229 | 251 | 1079-1082, 1152-1154, 1455, 1457, 1458 |
| 1229 | 11 | 93 | 947, 949, 951-956 | 1367 | 154 | 176 | 1079-1082, 1152-1154 |
| 1229 | 227 | 264 | 947, 949, 951-956 | 1368 | 126 | 145 | 1083, 1087 |
| 1230 | 2 | 90 | 947, 949, 951-955 | 1368 | 153 | 177 | 1083, 1087 |
| 1230 | 92 | 174 | 947, 949, 951-955 | 1368 | 186 | 208 | 1083, 1087 |
| 1230 | 308 | 345 | 947, 949, 951-955 | 1368 | 224 | 253 | 1083, 1087 |
| 1231 | 2 | 29 | 947, 949, 951-956 | 1369 | 161 | 180 | 1083, 1084, 1089 |
| 1231 | 31 | 113 | 947, 949, 951-956 | 1370 | 124 | 143 | 1083, 1087 |
| 1231 | 247 | 284 | 947, 949, 951-956 | 1370 | 151 | 175 | 1083, 1087 |
| 1232 | 2 | 34 | 947, 949, 951-956 | 1370 | 184 | 206 | 1083, 1087 |
| 1232 | 36 | 118 | 947, 949, 951-956 | 1370 | 222 | 251 | 1083, 1087 |
| 1232 | 252 | 289 | 947, 949, 951-956 | 1369 | 278 | 303 | 1083, 1084, 1089 |
| 1233 | 2 | 47 | 947, 949, 951-956 | 1369 | 182 | 201 | 1083, 1084, 1089 |
| 1233 | 49 | 131 | 947, 949, 951-956 | 1371 | 1 | 71 | 1093-1095, 1098, 1100-1103 |
| 1233 | 265 | 302 | 947, 949, 951-956 | 1371 | 82 | 122 | 1093-1095, 1098, 1100-1103 |
| 1226 | 7 | 96 | 947, 949, 951-955 | 1371 | 124 | 180 | 1093-1095, 1098, 1100-1103 |
| 1227 | 1 | 91 | 947, 949, 951-955 | 1371 | 182 | 244 | 1093-1095, 1098, 1100-1103 |

TABLE 4-continued

| QUERY Polynucleotide | | | QUERY Polynucleotide | | |
|---|---|---|---|---|---|
| SEQ ID NO: | start | SUBJECT Polynucleotide end SEQ ID NO: | SEQ ID NO: | start | SUBJECT Polynucleotide end SEQ ID NO: |
| 1226 | 8 | 96 947, 949, 951-955 | 1372 | 16 | 56 1093-1095, 1098, 1100-1103 |
| 1227 | 3 | 91 947, 949, 951-955 | 1372 | 58 | 114 1093-1095, 1098, 1100-1103 |
| 1230 | 1 | 90 947, 949, 951-955 | 1372 | 116 | 178 1093-1095, 1098, 1100-1103 |
| 1226 | 54 | 96 947, 949, 951-955 | 1373 | 2 | 61 1093-1095, 1098, 1100-1103 |
| 1227 | 49 | 91 947, 949, 951-955 | 1373 | 72 | 112 1093-1095, 1098, 1100-1103 |
| 1228 | 1 | 44 947, 949, 951-956 | 1373 | 114 | 170 1093-1095, 1098, 1100-1103 |
| 1230 | 48 | 90 947, 949, 951-955 | 1373 | 172 | 234 1093-1095, 1098, 1100-1103 |
| 1233 | 5 | 47 947, 949, 951-956 | 1374 | 1 | 68 1093-1095, 1098, 1100-1103 |
| 1224 | 125 | 145 947-949, 951-956 | 1374 | 79 | 119 1093-1095, 1098, 1100-1103 |
| 1225 | 274 | 294 947, 949, 951-956 | 1374 | 121 | 177 1093-1095, 1098, 1100-1103 |
| 1228 | 330 | 350 947, 949, 951-956 | 1374 | 179 | 241 1093-1095, 1098, 1100-1103 |
| 1229 | 295 | 315 947, 949, 951-956 | 1375 | 2 | 41 1093-1095, 1098, 1100-1103 |
| 1231 | 315 | 335 947, 949, 951-956 | 1375 | 52 | 92 1093-1095, 1098, 1100-1103 |
| 1232 | 320 | 340 947, 949, 951-956 | 1375 | 94 | 150 1093-1095, 1098, 1100-1103 |
| 1233 | 333 | 351 947, 949, 951-956 | 1375 | 152 | 214 1093-1095, 1098, 1100-1103 |
| 1234 | 50 | 135 960, 964 | 1376 | 7 | 47 1093-1095, 1098, 1100-1103 |
| 1234 | 149 | 168 960, 964 | 1376 | 49 | 105 1093-1095, 1098, 1100-1103 |
| 1234 | 170 | 350 960, 964 | 1376 | 107 | 169 1093-1095, 1098, 1100-1103 |
| 1235 | 175 | 260 960, 963, 964 | 1371 | 124 | 148 1093-1095, 1098, 1100-1103 |
| 1235 | 274 | 293 960, 963, 964 | 1372 | 58 | 82 1093-1095, 1098, 1100-1103 |
| 1235 | 295 | 351 960, 963, 964 | 1373 | 114 | 138 1093-1095, 1098, 1100-1103 |
| 1236 | 190 | 275 960, 963, 964 | 1374 | 121 | 145 1093-1095, 1098, 1100-1103 |
| 1236 | 289 | 308 960, 963, 964 | 1375 | 94 | 118 1093-1095, 1098, 1100-1103 |
| 1236 | 310 | 351 960, 963, 964 | 1376 | 49 | 73 1093-1095, 1098, 1100-1103 |
| 1237 | 269 | 350 960, 963, 964 | 1371 | 182 | 276 1093-1095, 1098, 1100-1103 |
| 1238 | 51 | 136 960, 964 | 1371 | 278 | 333 1093-1095, 1098, 1100-1103 |
| 1238 | 150 | 169 960, 964 | 1372 | 116 | 210 1093-1095, 1098, 1100-1103 |
| 1238 | 171 | 350 960, 964 | 1372 | 212 | 267 1093-1095, 1098, 1100-1103 |
| 1239 | 50 | 135 960, 964 | 1372 | 269 | 309 1093-1095, 1098, 1100-1103 |
| 1239 | 149 | 168 960, 964 | 1372 | 311 | 352 1093-1095, 1098, 1100-1103 |
| 1239 | 170 | 351 960, 964 | 1373 | 172 | 266 1093-1095, 1098, 1100-1103 |
| 1240 | 103 | 188 960, 963, 964 | 1373 | 268 | 323 1093-1095, 1098, 1100-1103 |
| 1240 | 202 | 221 960, 963, 964 | 1373 | 325 | 351 1093-1095, 1098, 1100-1103 |
| 1240 | 223 | 351 960, 963, 964 | 1374 | 179 | 273 1093-1095, 1098, 1100-1103 |
| 1241 | 269 | 351 960, 963, 964 | 1374 | 275 | 330 1093-1095, 1098, 1100-1103 |
| 1242 | 87 | 172 960, 963, 964 | 1374 | 332 | 351 1093-1095, 1098, 1100-1103 |
| 1242 | 186 | 205 960, 963, 964 | 1375 | 152 | 246 1093-1095, 1098, 1100-1103 |
| 1242 | 207 | 351 960, 963, 964 | 1375 | 248 | 303 1093-1095, 1098, 1100-1103 |
| 1235 | 2 | 23 960, 963, 964 | 1375 | 305 | 345 1093-1095, 1098, 1100-1103 |
| 1235 | 25 | 114 960, 963, 964 | 1376 | 107 | 201 1093-1095, 1098, 1100-1103 |
| 1236 | 2 | 38 960, 963, 964 | 1376 | 203 | 258 1093-1095, 1098, 1100-1103 |
| 1236 | 40 | 129 960, 963, 964 | 1376 | 260 | 300 1093-1095, 1098, 1100-1103 |
| 1237 | 2 | 39 960, 963, 964 | 1376 | 302 | 342 1093-1095, 1098, 1100-1103 |
| 1237 | 41 | 117 960, 963, 964 | 1371 | 278 | 303 1093-1095, 1098, 1100-1103 |
| 1237 | 119 | 208 960, 963, 964 | 1372 | 212 | 237 1093-1095, 1098, 1100-1103 |
| 1240 | 2 | 42 960, 963, 964 | 1373 | 268 | 293 1093-1095, 1098, 1100-1103 |
| 1241 | 2 | 39 960, 963, 964 | 1374 | 275 | 300 1093-1095, 1098, 1100-1103 |
| 1241 | 41 | 117 960, 963, 964 | 1375 | 248 | 273 1093-1095, 1098, 1100-1103 |
| 1241 | 119 | 208 960, 963, 964 | 1376 | 203 | 228 1093-1095, 1098, 1100-1103 |
| 1242 | 2 | 26 960, 963, 964 | 1371 | 124 | 155 1093-1095, 1098, 1100-1103 |
| 1234 | 38 | 135 960, 964 | 1372 | 58 | 89 1093-1095, 1098, 1100-1103 |
| 1234 | 170 | 211 960, 964 | 1373 | 114 | 145 1093-1095, 1098, 1100-1103 |
| 1235 | 25 | 136 960, 963, 964 | 1374 | 121 | 152 1093-1095, 1098, 1100-1103 |
| 1235 | 163 | 260 960, 963, 964 | 1375 | 94 | 125 1093-1095, 1098, 1100-1103 |
| 1235 | 295 | 336 960, 963, 964 | 1376 | 49 | 80 1093-1095, 1098, 1100-1103 |
| 1236 | 1 | 38 960, 963, 964 | 1371 | 182 | 241 1093-1095, 1098, 1100-1103 |
| 1236 | 40 | 151 960, 963, 964 | 1372 | 116 | 175 1093-1095, 1098, 1100-1103 |
| 1236 | 178 | 275 960, 963, 964 | 1373 | 172 | 231 1093-1095, 1098, 1100-1103 |
| 1237 | 81 | 117 960, 963, 964 | 1374 | 179 | 238 1093-1095, 1098, 1100-1103 |
| 1237 | 119 | 230 960, 963, 964 | 1375 | 152 | 211 1093-1095, 1098, 1100-1103 |
| 1237 | 257 | 350 960, 963, 964 | 1376 | 107 | 166 1093-1095, 1098, 1100-1103 |
| 1238 | 39 | 136 960, 964 | 1371 | 278 | 325 1093-1095, 1098, 1100-1103 |
| 1238 | 171 | 212 960, 964 | 1372 | 212 | 259 1093-1095, 1098, 1100-1103 |
| 1239 | 38 | 135 960, 964 | 1373 | 268 | 315 1093-1095, 1098, 1100-1103 |
| 1239 | 170 | 211 960, 964 | 1374 | 275 | 322 1093-1095, 1098, 1100-1103 |
| 1240 | 2 | 64 960, 963, 964 | 1375 | 248 | 295 1093-1095, 1098, 1100-1103 |
| 1240 | 91 | 188 960, 963, 964 | 1376 | 203 | 250 1093-1095, 1098, 1100-1103 |
| 1240 | 223 | 264 960, 963, 964 | 1309 | 1 | 69 1114, 1115 |
| 1241 | 81 | 117 960, 963, 964 | 1309 | 71 | 96 1114, 1115 |
| 1241 | 119 | 230 960, 963, 964 | 1309 | 98 | 144 1114, 1115 |
| 1241 | 257 | 351 960, 963, 964 | 1309 | 152 | 195 1114, 1115 |
| 1242 | 2 | 48 960, 963, 964 | 1309 | 197 | 237 1114, 1115 |
| 1242 | 75 | 172 960, 963, 964 | 1309 | 254 | 352 1114, 1115 |

TABLE 4-continued

| QUERY Polynucleotide SEQ ID NO: | start | end | SUBJECT Polynucleotide SEQ ID NO: | QUERY Polynucleotide SEQ ID NO: | start | end | SUBJECT Polynucleotide SEQ ID NO: |
|---|---|---|---|---|---|---|---|
| 1242 | 207 | 248 | 960, 963, 964 | 1310 | 25 | 92 | 1114, 1115 |
| 1243 | 118 | 158 | 965, 966, 968, 969 | 1310 | 94 | 119 | 1114, 1115 |
| 1243 | 283 | 304 | 965, 966, 968, 969 | 1310 | 121 | 167 | 1114, 1115 |
| 1243 | 310 | 348 | 965, 966, 968, 969 | 1310 | 175 | 218 | 1114, 1115 |
| 1244 | 165 | 205 | 965, 966, 968, 969 | 1310 | 220 | 260 | 1114, 1115 |
| 1244 | 330 | 351 | 965, 966, 968, 969 | 1310 | 277 | 351 | 1114, 1115 |
| 1246 | 205 | 245 | 965, 966, 967, 968, 969 | 1311 | 7 | 74 | 1114, 1115 |
| 1247 | 206 | 246 | 965, 966, 967, 968, 969 | 1311 | 76 | 101 | 1114, 1115 |
| 1248 | 163 | 203 | 965, 966, 968, 969 | 1311 | 103 | 149 | 1114, 1115 |
| 1248 | 328 | 349 | 965, 966, 968, 969 | 1311 | 157 | 200 | 1114, 1115 |
| 1245 | 1 | 20 | 967 | 1311 | 202 | 242 | 1114, 1115 |
| 1245 | 22 | 42 | 967 | 1311 | 259 | 351 | 1114, 1115 |
| 1245 | 104 | 135 | 967 | 1312 | 9 | 76 | 1114, 1115 |
| 1245 | 137 | 155 | 967 | 1312 | 78 | 103 | 1114, 1115 |
| 1245 | 187 | 209 | 967 | 1312 | 105 | 151 | 1114, 1115 |
| 1246 | 36 | 58 | 965, 966, 967, 968, 969 | 1312 | 159 | 202 | 1114, 1115 |
| 1247 | 37 | 59 | 965, 966, 967, 968, 969 | 1312 | 204 | 244 | 1114, 1115 |
| 1244 | 330 | 352 | 965, 966, 968, 969 | 1312 | 261 | 352 | 1114, 1115 |
| 1249 | 2 | 20 | 970, 973, 974, 978, 979 | 1309 | 2 | 69 | 1114, 1115 |
| 1250 | 5 | 84 | 969-971, 973-979 | 1309 | 254 | 327 | 1114, 1115 |
| 1250 | 86 | 270 | 969-971, 973-979 | 1310 | 22 | 92 | 1114, 1115 |
| 1250 | 278 | 306 | 969-971, 973-979 | 1310 | 277 | 350 | 1114, 1115 |
| 1250 | 326 | 351 | 969-971, 973-979 | 1311 | 4 | 74 | 1114, 1115 |
| 1251 | 2 | 52 | 969-971, 973-979 | 1311 | 259 | 332 | 1114, 1115 |
| 1251 | 54 | 238 | 969-971, 973-979 | 1312 | 6 | 76 | 1114, 1115 |
| 1251 | 246 | 274 | 969-971, 973-979 | 1312 | 261 | 334 | 1114, 1115 |
| 1251 | 294 | 322 | 969-971, 973-979 | 1315 | 56 | 87 | 1117, 1119-1125 |
| 1253 | 115 | 194 | 969-971, 973-979 | 1315 | 91 | 114 | 1117, 1119-1125 |
| 1253 | 196 | 351 | 969-971, 973-979 | 1315 | 116 | 144 | 1117, 1119-1125 |
| 1254 | 3 | 31 | 970, 971, 973, 974, 977-979 | 1315 | 146 | 171 | 1117, 1119-1125 |
| 1254 | 51 | 79 | 970, 971, 973, 974, 977-979 | 1315 | 185 | 225 | 1117, 1119-1125 |
| 1255 | 282 | 352 | 970, 971, 973-978, 1626, 1629 | 1315 | 275 | 294 | 1117, 1119-1125 |
| 1256 | 1 | 53 | 970, 971, 973-978 | 1315 | 317 | 342 | 1117, 1119-1125 |
| 1256 | 55 | 239 | 970, 971, 973-978 | 1316 | 22 | 45 | 1117, 1119-1125 |
| 1256 | 247 | 275 | 970, 971, 973-978 | 1316 | 47 | 75 | 1117, 1119-1125 |
| 1256 | 295 | 323 | 970, 971, 973-978 | 1316 | 77 | 102 | 1117, 1119-1125 |
| 1257 | 6 | 85 | 970, 971, 973-978 | 1316 | 116 | 156 | 1117, 1119-1125 |
| 1257 | 87 | 271 | 970, 971, 973-978 | 1316 | 206 | 225 | 1117, 1119-1125 |
| 1257 | 279 | 307 | 970, 971, 973-978 | 1316 | 248 | 273 | 1117, 1119-1125 |
| 1257 | 327 | 351 | 970, 971, 973-978 | 1316 | 275 | 317 | 1117, 1119-1125 |
| 1250 | 1 | 84 | 969-971, 973-979 | 1318 | 144 | 175 | 1117, 1119-1125 |
| 1250 | 326 | 352 | 969-971, 973-979 | 1318 | 179 | 202 | 1117, 1119-1125 |
| 1251 | 294 | 319 | 969-971, 973-979 | 1318 | 204 | 232 | 1117, 1119-1125 |
| 1253 | 112 | 194 | 969-971, 973-979 | 1318 | 234 | 259 | 1117, 1119-1125 |
| 1254 | 51 | 76 | 970, 971, 973, 974, 977-979 | 1318 | 273 | 313 | 1117, 1119-1125 |
| 1255 | 279 | 352 | 970, 971, 973-978, 1626, 1629 | 1319 | 2 | 20 | 1117, 1119-1125 |
| 1256 | 295 | 320 | 970, 971, 973-978 | 1319 | 24 | 47 | 1117, 1119-1125 |
| 1257 | 3 | 85 | 970, 971, 973-978 | 1319 | 49 | 77 | 1117, 1119-1125 |
| 1252 | 31 | 89 | 972 | 1319 | 79 | 104 | 1117, 1119-1125 |
| 1252 | 91 | 236 | 972 | 1319 | 118 | 158 | 1117, 1119-1125 |
| 1252 | 238 | 266 | 972 | 1319 | 208 | 227 | 1117, 1119-1125 |
| 1252 | 277 | 337 | 972 | 1319 | 250 | 275 | 1117, 1119-1125 |
| 1249 | 2 | 23 | 970, 973, 974, 978, 979 | 1319 | 277 | 319 | 1117, 1119-1125 |
| 1249 | 25 | 44 | 970, 973, 974, 978, 979 | 1313 | 17 | 81 | 1118, 1125 |
| 1250 | 34 | 84 | 969-971, 973-979 | 1313 | 92 | 117 | 1118, 1125 |
| 1251 | 1 | 52 | 969-971, 973-979 | 1313 | 137 | 204 | 1118, 1125 |
| 1251 | 294 | 325 | 969-971, 973-979 | 1313 | 215 | 240 | 1118, 1125 |
| 1251 | 327 | 346 | 969-971, 973-979 | 1313 | 242 | 291 | 1118, 1125 |
| 1253 | 144 | 194 | 969-971, 973-979 | 1313 | 293 | 329 | 1118, 1125 |
| 1254 | 51 | 82 | 970, 971, 973, 974, 977-979 | 1314 | 22 | 89 | 1118-1125 |
| 1254 | 84 | 103 | 970, 971, 973, 974, 977-979 | 1314 | 100 | 125 | 1118-1125 |
| 1255 | 311 | 352 | 970, 971, 973-978, 1626, 1629 | 1314 | 127 | 176 | 1118-1125 |
| 1256 | 3 | 53 | 970, 971, 973-978 | 1314 | 178 | 214 | 1118-1125 |
| 1256 | 295 | 326 | 970, 971, 973-978 | 1317 | 25 | 92 | 1118, 1120-1122, 1124, 1125 |
| 1256 | 328 | 347 | 970, 971, 973-978 | 1317 | 103 | 128 | 1118, 1120-1122, 1124, 1125 |
| 1257 | 35 | 85 | 970, 971, 973-978 | 1317 | 130 | 179 | 1118, 1120-1122, 1124, 1125 |
| 1250 | 47 | 84 | 969-971, 973-979 | 1317 | 181 | 217 | 1118, 1120-1122, 1124, 1125 |
| 1251 | 15 | 52 | 969-971, 973-979 | 1314 | 332 | 351 | 1118-1125 |
| 1253 | 157 | 194 | 969-971, 973-979 | 1315 | 27 | 51 | 1117, 1119-1125 |
| 1255 | 324 | 352 | 970, 971, 973-978, 1626, 1629 | 1316 | 275 | 306 | 1117, 1119-1125 |
| 1256 | 16 | 53 | 970, 971, 973-978 | 1318 | 115 | 139 | 1117, 1119-1125 |
| 1257 | 48 | 85 | 970, 971, 973-978 | 1319 | 277 | 308 | 1117, 1119-1125 |
| 1250 | 2 | 84 | 969-971, 973-979 | 1314 | 330 | 351 | 1118-1125 |

TABLE 4-continued

| QUERY Polynucleotide SEQ ID NO: | start | end | SUBJECT Polynucleotide SEQ ID NO: | QUERY Polynucleotide SEQ ID NO: | start | end | SUBJECT Polynucleotide SEQ ID NO: |
|---|---|---|---|---|---|---|---|
| 1250 | 86 | 241 | 969-971, 973-979 | 1315 | 25 | 51 | 1117, 1119-1125 |
| 1251 | 54 | 209 | 969-971, 973-979 | 1316 | 275 | 303 | 1117, 1119-1125 |
| 1253 | 1 | 68 | 969-971, 973-979 | 1317 | 333 | 351 | 1118, 1120-1122, 1124, 1125 |
| 1253 | 91 | 194 | 969-971, 973-979 | 1318 | 113 | 139 | 1117, 1119-1125 |
| 1253 | 196 | 352 | 969-971, 973-979 | 1319 | 277 | 305 | 1117, 1119-1125 |
| 1255 | 169 | 235 | 970, 971, 973-978, 1626, 1629 | 1314 | 262 | 293 | 1118-1125 |
| 1255 | 258 | 352 | 970, 971, 973-978, 1626, 1629 | 1314 | 295 | 314 | 1118-1125 |
| 1256 | 55 | 210 | 970, 971, 973-978 | 1314 | 316 | 351 | 1118-1125 |
| 1257 | 1 | 85 | 970, 971, 973-978 | 1315 | 11 | 51 | 1117, 1119-1125 |
| 1257 | 87 | 242 | 970, 971, 973-978 | 1317 | 265 | 296 | 1118, 1120-1122, 1124, 1125 |
| 1250 | 86 | 110 | 969-971, 973-979 | 1317 | 298 | 317 | 1118, 1120-1122, 1124, 1125 |
| 1251 | 54 | 78 | 969-971, 973-979 | 1317 | 319 | 351 | 1118, 1120-1122, 1124, 1125 |
| 1253 | 2 | 68 | 969-971, 973-979 | 1318 | 45 | 76 | 1117, 1119-1125 |
| 1253 | 196 | 220 | 969-971, 973-979 | 1318 | 78 | 97 | 1117, 1119-1125 |
| 1255 | 39 | 130 | 970, 971, 973-978, 1626, 1629 | 1318 | 99 | 139 | 1117, 1119-1125 |
| 1255 | 132 | 235 | 970, 971, 973-978, 1626, 1629 | 1316 | 275 | 324 | 1117, 1119-1125 |
| 1256 | 55 | 79 | 970, 971, 973-978 | 1319 | 277 | 326 | 1117, 1119-1125 |
| 1257 | 87 | 111 | 970, 971, 973-978 | 1299 | 50 | 96 | 1126-1131, 1651-1653 |
| 1250 | 326 | 350 | 969-971, 973-979 | 1300 | 2 | 43 | 1126-1131, 1651-1653 |
| 1251 | 294 | 318 | 969-971, 973-979 | 1300 | 66 | 112 | 1126-1131, 1651-1653 |
| 1253 | 110 | 194 | 969-971, 973-979 | 1300 | 123 | 154 | 1126-1131, 1651-1653 |
| 1254 | 51 | 75 | 970, 971, 973, 974, 977-979 | 1300 | 183 | 211 | 1126-1131, 1651-1653 |
| 1255 | 277 | 352 | 970, 971, 973-978, 1626, 1629 | 1300 | 213 | 232 | 1126-1131, 1651-1653 |
| 1256 | 295 | 319 | 970, 971, 973-978 | 1300 | 264 | 310 | 1126-1131, 1651-1653 |
| 1257 | 327 | 352 | 970, 971, 973-978 | 1301 | 1 | 35 | 1126-1131 |
| 1250 | 32 | 84 | 969-971, 973-979 | 1301 | 37 | 84 | 1126-1131 |
| 1253 | 142 | 194 | 969-971, 973-979 | 1301 | 107 | 153 | 1126-1131 |
| 1255 | 309 | 352 | 970, 971, 973-978, 1626, 1629 | 1301 | 164 | 195 | 1126-1131 |
| 1257 | 33 | 85 | 970, 971, 973-978 | 1301 | 224 | 252 | 1126-1131 |
| 1249 | 46 | 68 | 970, 973, 974, 978, 979 | 1301 | 254 | 273 | 1126-1131 |
| 1250 | 61 | 84 | 969-971, 973-979 | 1301 | 305 | 351 | 1126-1131 |
| 1251 | 29 | 52 | 969-971, 973-979 | 1302 | 26 | 54 | 1126-1131, 1651-1653 |
| 1253 | 171 | 194 | 969-971, 973-979 | 1302 | 56 | 75 | 1126-1131, 1651-1653 |
| 1254 | 105 | 127 | 970, 971, 973, 974, 977-979 | 1302 | 107 | 153 | 1126-1131, 1651-1653 |
| 1256 | 30 | 53 | 970, 971, 973-978 | 1303 | 11 | 39 | 1126-1131, 1651-1653 |
| 1257 | 62 | 85 | 970, 971, 973-978 | 1303 | 41 | 60 | 1126-1131, 1651-1653 |
| 1259 | 192 | 226 | 999-1004 | 1303 | 92 | 138 | 1126-1131, 1651-1653 |
| 1259 | 249 | 298 | 999-1004 | 1299 | 50 | 114 | 1126-1131, 1651-1653 |
| 1259 | 321 | 352 | 999-1004 | 1299 | 131 | 162 | 1126-1131, 1651-1653 |
| 1260 | 190 | 224 | 999-1004 | 1299 | 215 | 236 | 1126-1131, 1651-1653 |
| 1260 | 247 | 296 | 999-1004 | 1299 | 248 | 270 | 1126-1131, 1651-1653 |
| 1260 | 319 | 351 | 999-1004 | 1299 | 272 | 309 | 1126-1131, 1651-1653 |
| 1261 | 99 | 133 | 999-1004 | 1300 | 264 | 328 | 1126-1131, 1651-1653 |
| 1261 | 156 | 205 | 999-1004 | 1302 | 107 | 171 | 1126-1131, 1651-1653 |
| 1261 | 228 | 289 | 999-1004 | 1302 | 188 | 219 | 1126-1131, 1651-1653 |
| 1261 | 300 | 334 | 999-1004 | 1302 | 272 | 293 | 1126-1131, 1651-1653 |
| 1262 | 82 | 116 | 999-1004 | 1302 | 305 | 327 | 1126-1131, 1651-1653 |
| 1262 | 139 | 188 | 999-1004 | 1302 | 329 | 351 | 1126-1131, 1651-1653 |
| 1262 | 211 | 272 | 999-1004 | 1303 | 92 | 156 | 1126-1131, 1651-1653 |
| 1262 | 283 | 317 | 999-1004 | 1303 | 173 | 204 | 1126-1131, 1651-1653 |
| 1262 | 319 | 350 | 999-1004 | 1303 | 257 | 278 | 1126-1131, 1651-1653 |
| 1263 | 324 | 351 | 999-1004 | 1303 | 290 | 312 | 1126-1131, 1651-1653 |
| 1264 | 191 | 225 | 999-1004 | 1303 | 314 | 351 | 1126-1131, 1651-1653 |
| 1264 | 248 | 297 | 999-1004 | 1299 | 272 | 352 | 1126-1131, 1651-1653 |
| 1264 | 320 | 351 | 999-1004 | 1299 | 272 | 344 | 1126-1131, 1651-1653 |
| 1265 | 98 | 132 | 999-1004 | 1299 | 272 | 318 | 1126-1131, 1651-1653 |
| 1265 | 155 | 204 | 999-1004 | 1299 | 272 | 310 | 1126-1131, 1651-1653 |
| 1265 | 227 | 288 | 999-1004 | 1304 | 2 | 25 | 1132, 1134, 1135, 1136 |
| 1265 | 299 | 333 | 999-1004 | 1304 | 36 | 169 | 1132, 1134, 1135, 1136 |
| 1259 | 95 | 145 | 999-1004 | 1304 | 186 | 214 | 1132, 1134, 1135, 1136 |
| 1259 | 165 | 226 | 999-1004 | 1304 | 231 | 250 | 1132, 1134, 1135, 1136 |
| 1260 | 93 | 143 | 999-1004 | 1304 | 264 | 307 | 1132, 1134, 1135, 1136 |
| 1260 | 163 | 224 | 999-1004 | 1306 | 2 | 70 | 1132, 1134, 1135, 1136 |
| 1261 | 1 | 52 | 999-1004 | 1306 | 87 | 115 | 1132, 1134, 1135, 1136 |
| 1261 | 72 | 133 | 999-1004 | 1306 | 132 | 151 | 1132, 1134, 1135, 1136 |
| 1262 | 1 | 35 | 999-1004 | 1306 | 165 | 208 | 1132, 1134, 1135, 1136 |
| 1262 | 55 | 116 | 999-1004 | 1307 | 1 | 27 | 1132, 1134, 1135, 1136 |
| 1263 | 227 | 277 | 999-1004 | 1307 | 29 | 69 | 1132, 1134, 1135, 1136 |
| 1263 | 297 | 351 | 999-1004 | 1307 | 80 | 213 | 1132, 1134, 1135, 1136 |
| 1264 | 94 | 144 | 999-1004 | 1307 | 230 | 258 | 1132, 1134, 1135, 1136 |
| 1264 | 164 | 225 | 999-1004 | 1307 | 275 | 294 | 1132, 1134, 1135, 1136 |
| 1265 | 2 | 51 | 999-1004 | 1307 | 308 | 351 | 1132, 1134, 1135, 1136 |
| 1265 | 71 | 132 | 999-1004 | 1308 | 2 | 33 | 1132, 1134, 1135, 1136 |

TABLE 4-continued

| QUERY Polynucleotide SEQ ID NO: | start | end | SUBJECT Polynucleotide SEQ ID NO: | QUERY Polynucleotide SEQ ID NO: | start | end | SUBJECT Polynucleotide SEQ ID NO: |
|---|---|---|---|---|---|---|---|
| 1259 | 15 | 40 | 999-1004 | 1308 | 44 | 177 | 1132, 1134, 1135, 1136 |
| 1259 | 42 | 64 | 999-1004 | 1308 | 194 | 222 | 1132, 1134, 1135, 1136 |
| 1259 | 66 | 88 | 999-1004 | 1308 | 239 | 258 | 1132, 1134, 1135, 1136 |
| 1259 | 90 | 145 | 999-1004 | 1308 | 272 | 315 | 1132, 1134, 1135, 1136 |
| 1259 | 165 | 219 | 999-1004 | 1347 | 2 | 28 | 1132, 1134, 1135, 1136 |
| 1260 | 13 | 38 | 999-1004 | 1347 | 39 | 172 | 1132, 1134, 1135, 1136 |
| 1260 | 40 | 62 | 999-1004 | 1347 | 189 | 217 | 1132, 1134, 1135, 1136 |
| 1260 | 64 | 86 | 999-1004 | 1347 | 234 | 253 | 1132, 1134, 1135, 1136 |
| 1260 | 88 | 143 | 999-1004 | 1347 | 267 | 310 | 1132, 1134, 1135, 1136 |
| 1260 | 163 | 217 | 999-1004 | 1305 | 1 | 133 | 1133, 1137, 1138, 1580, 1581, 1583 |
| 1261 | 2 | 52 | 999-1004 | 1305 | 135 | 154 | 1133, 1137, 1138, 1580, 1581, 1583 |
| 1261 | 72 | 126 | 999-1004 | 1305 | 156 | 178 | 1133, 1137, 1138, 1580, 1581, 1583 |
| 1262 | 55 | 109 | 999-1004 | 1305 | 195 | 280 | 1133, 1137, 1138, 1580, 1581, 1583 |
| 1263 | 1 | 60 | 999-1004 | 1305 | 330 | 351 | 1133, 1137, 1138, 1580, 1581, 1583 |
| 1263 | 105 | 127 | 999-1004 | 1344 | 13 | 35 | 1133, 1137, 1138, 1580, 1581, 1583 |
| 1263 | 147 | 172 | 999-1004 | 1344 | 52 | 137 | 1133, 1137, 1138, 1580, 1581, 1583 |
| 1263 | 174 | 196 | 999-1004 | 1344 | 187 | 208 | 1133, 1137, 1138, 1580, 1581, 1583 |
| 1263 | 198 | 220 | 999-1004 | 1345 | 50 | 181 | 1133, 1137, 1138, 1580, 1581, 1583 |
| 1263 | 222 | 277 | 999-1004 | 1345 | 183 | 202 | 1133, 1137, 1138, 1580, 1581, 1583 |
| 1263 | 297 | 352 | 999-1004 | 1345 | 204 | 226 | 1133, 1137, 1138, 1580, 1581, 1583 |
| 1264 | 14 | 39 | 999-1004 | 1345 | 243 | 328 | 1133, 1137, 1138, 1580, 1581, 1583 |
| 1264 | 41 | 63 | 999-1004 | 1346 | 2 | 81 | 1133, 1137, 1138 |
| 1264 | 65 | 87 | 999-1004 | 1346 | 131 | 152 | 1133, 1137, 1138 |
| 1264 | 89 | 144 | 999-1004 | 1304 | 1 | 25 | 1132, 1134, 1135, 1136 |
| 1264 | 164 | 218 | 999-1004 | 1304 | 264 | 334 | 1132, 1134, 1135, 1136 |
| 1265 | 71 | 125 | 999-1004 | 1306 | 165 | 235 | 1132, 1134, 1135, 1136 |
| 1259 | 190 | 226 | 999-1004 | 1307 | 46 | 69 | 1132, 1134, 1135, 1136 |
| 1260 | 188 | 224 | 999-1004 | 1308 | 10 | 33 | 1132, 1134, 1135, 1136 |
| 1261 | 97 | 133 | 999-1004 | 1308 | 272 | 342 | 1132, 1134, 1135, 1136 |
| 1262 | 80 | 116 | 999-1004 | 1347 | 5 | 28 | 1132, 1134, 1135, 1136 |
| 1263 | 322 | 351 | 999-1004 | 1347 | 267 | 337 | 1132, 1134, 1135, 1136 |
| 1264 | 189 | 225 | 999-1004 | 1304 | 101 | 169 | 1132, 1134, 1135, 1136 |
| 1265 | 96 | 132 | 999-1004 | 1306 | 1 | 70 | 1132, 1134, 1135, 1136 |
| 1259 | 96 | 145 | 999-1004 | 1306 | 237 | 310 | 1132, 1134, 1135, 1136 |
| 1260 | 94 | 143 | 999-1004 | 1306 | 312 | 352 | 1132, 1134, 1135, 1136 |
| 1261 | 3 | 52 | 999-1004 | 1307 | 145 | 213 | 1132, 1134, 1135, 1136 |
| 1263 | 228 | 277 | 999-1004 | 1308 | 109 | 177 | 1132, 1134, 1135, 1136 |
| 1264 | 95 | 144 | 999-1004 | 1347 | 104 | 172 | 1132, 1134, 1135, 1136 |
| 1265 | 1 | 51 | 999-1004 | 1307 | 38 | 69 | 1132, 1134, 1135, 1136 |
| 1259 | 165 | 218 | 999-1004 | 1308 | 1 | 33 | 1132, 1134, 1135, 1136 |
| 1260 | 163 | 216 | 999-1004 | 1344 | 187 | 239 | 1133, 1137, 1138, 1580, 1581, 1583 |
| 1261 | 72 | 125 | 999-1004 | 1344 | 241 | 272 | 1133, 1137, 1138, 1580, 1581, 1583 |
| 1262 | 55 | 108 | 999-1004 | 1344 | 286 | 308 | 1133, 1137, 1138, 1580, 1581, 1583 |
| 1263 | 2 | 60 | 999-1004 | 1344 | 310 | 329 | 1133, 1137, 1138, 1580, 1581, 1583 |
| 1263 | 297 | 350 | 999-1004 | 1346 | 131 | 183 | 1133, 1137, 1138 |
| 1264 | 164 | 217 | 999-1004 | 1346 | 185 | 216 | 1133, 1137, 1138 |
| 1265 | 71 | 124 | 999-1004 | 1346 | 230 | 252 | 1133, 1137, 1138 |
| 1266 | 2 | 39 | 1016-1023 | 1346 | 254 | 273 | 1133, 1137, 1138 |
| 1266 | 41 | 87 | 1016-1023 | 1305 | 227 | 280 | 1133, 1137, 1138, 1580, 1581, 1583 |
| 1266 | 89 | 129 | 1016-1023 | 1344 | 84 | 137 | 1133, 1137, 1138, 1580, 1581, 1583 |
| 1267 | 2 | 74 | 1016-1023 | 1345 | 275 | 328 | 1133, 1137, 1138, 1580, 1581, 1583 |
| 1267 | 76 | 122 | 1016-1023 | 1346 | 28 | 81 | 1133, 1137, 1138 |
| 1267 | 124 | 164 | 1016-1023 | 1346 | 290 | 351 | 1133, 1137, 1138 |
| 1268 | 2 | 53 | 1016-1023 | 1348 | 44 | 66 | 1139, 1140, 1141, 1142 |
| 1268 | 55 | 101 | 1016-1023 | 1348 | 104 | 129 | 1139, 1140, 1141, 1142 |
| 1268 | 103 | 143 | 1016-1023 | 1348 | 131 | 156 | 1139, 1140, 1141, 1142 |
| 1269 | 2 | 72 | 1016-1023 | 1348 | 158 | 195 | 1139, 1140, 1141, 1142 |
| 1269 | 74 | 120 | 1016-1023 | 1348 | 167 | 189 | 1139, 1140, 1141, 1142 |
| 1269 | 122 | 162 | 1016-1023 | 1348 | 197 | 237 | 1139, 1140, 1141, 1142 |
| 1270 | 2 | 107 | 1016-1023 | 1348 | 215 | 234 | 1139, 1140, 1141, 1142 |
| 1270 | 109 | 155 | 1016-1023 | 1348 | 4 | 49 | 1139, 1140, 1141, 1142 |
| 1270 | 157 | 197 | 1016-1023 | 1348 | 4 | 74 | 1139, 1140, 1141, 1142 |
| 1271 | 2 | 62 | 1016-1023 | 1348 | 4 | 85 | 1139, 1140, 1141, 1142 |
| 1271 | 64 | 110 | 1016-1023 | 1349 | 19 | 90 | 1143 |
| 1271 | 112 | 152 | 1016-1023 | 1349 | 146 | 207 | 1143 |
| 1266 | 131 | 177 | 1016-1023 | 1349 | 209 | 256 | 1143 |
| 1266 | 179 | 207 | 1016-1023 | 1350 | 32 | 51 | 1144-1151, 1703 |
| 1266 | 209 | 243 | 1016-1023 | 1350 | 71 | 90 | 1144-1151, 1703 |
| 1267 | 166 | 212 | 1016-1023 | 1351 | 118 | 137 | 1144-1151 |
| 1267 | 214 | 242 | 1016-1023 | 1351 | 157 | 176 | 1144-1151 |
| 1267 | 244 | 278 | 1016-1023 | 1353 | 81 | 100 | 1144-1151 |
| 1268 | 145 | 191 | 1016-1023 | 1353 | 120 | 139 | 1144-1151 |
| 1268 | 193 | 221 | 1016-1023 | 1354 | 1 | 42 | 1144-1151 |

TABLE 4-continued

| QUERY Polynucleotide SEQ ID NO: | start | end | SUBJECT Polynucleotide SEQ ID NO: | QUERY Polynucleotide SEQ ID NO: | start | end | SUBJECT Polynucleotide SEQ ID NO: |
|---|---|---|---|---|---|---|---|
| 1268 | 223 | 257 | 1016-1023 | 1354 | 218 | 237 | 1144-1151 |
| 1269 | 164 | 210 | 1016-1023 | 1354 | 257 | 276 | 1144-1151 |
| 1269 | 212 | 240 | 1016-1023 | 1356 | 43 | 62 | 1144-1151 |
| 1269 | 242 | 276 | 1016-1023 | 1356 | 82 | 101 | 1144-1151 |
| 1270 | 199 | 245 | 1016-1023 | 1350 | 176 | 201 | 1144-1151, 1703 |
| 1270 | 247 | 275 | 1016-1023 | 1350 | 209 | 231 | 1144-1151, 1703 |
| 1270 | 277 | 311 | 1016-1023 | 1350 | 236 | 267 | 1144-1151, 1703 |
| 1271 | 154 | 200 | 1016-1023 | 1351 | 262 | 287 | 1144-1151 |
| 1271 | 202 | 230 | 1016-1023 | 1351 | 295 | 317 | 1144-1151 |
| 1271 | 232 | 266 | 1016-1023 | 1351 | 322 | 351 | 1144-1151 |
| 1266 | 209 | 294 | 1016-1023 | 1353 | 225 | 250 | 1144-1151 |
| 1266 | 296 | 316 | 1016-1023 | 1353 | 258 | 280 | 1144-1151 |
| 1267 | 1 | 74 | 1016-1023 | 1353 | 285 | 316 | 1144-1151 |
| 1267 | 244 | 329 | 1016-1023 | 1356 | 187 | 212 | 1144-1151 |
| 1267 | 331 | 351 | 1016-1023 | 1356 | 220 | 242 | 1144-1151 |
| 1268 | 223 | 308 | 1016-1023 | 1356 | 247 | 278 | 1144-1151 |
| 1268 | 310 | 330 | 1016-1023 | 1350 | 236 | 265 | 1144-1151, 1703 |
| 1269 | 242 | 327 | 1016-1023 | 1351 | 322 | 352 | 1144-1151 |
| 1269 | 329 | 349 | 1016-1023 | 1353 | 285 | 314 | 1144-1151 |
| 1270 | 35 | 107 | 1016-1023 | 1356 | 247 | 276 | 1144-1151 |
| 1270 | 277 | 351 | 1016-1023 | 1350 | 287 | 306 | 1144-1151, 1703 |
| 1271 | 232 | 317 | 1016-1023 | 1350 | 323 | 348 | 1144-1151, 1703 |
| 1271 | 319 | 339 | 1016-1023 | 1352 | 2 | 21 | 1147, 1150, 1151, 1703 |
| 1266 | 296 | 318 | 1016-1023 | 1352 | 38 | 63 | 1147, 1150, 1151, 1703 |
| 1267 | 4 | 74 | 1016-1023 | 1355 | 5 | 24 | 1147, 1150, 1151, 1703 |
| 1268 | 310 | 332 | 1016-1023 | 1355 | 41 | 66 | 1147, 1150, 1151, 1703 |
| 1269 | 1 | 72 | 1016-1023 | 1356 | 298 | 317 | 1144-1151 |
| 1269 | 329 | 351 | 1016-1023 | 1358 | 322 | 351 | 1079-1082, 1152-1154, 1455, 1457, 1458 |
| 1270 | 37 | 107 | 1016-1023 | 1364 | 262 | 291 | 1079-1082, 1152-1154, 1455, 1457, 1458 |
| 1271 | 319 | 341 | 1016-1023 | 1366 | 229 | 258 | 1079-1082, 1152-1154, 1455, 1457, 1458 |
| 1266 | 131 | 157 | 1016-1023 | 1367 | 154 | 183 | 1079-1082, 1152-1154 |
| 1267 | 166 | 192 | 1016-1023 | 1361 | 2 | 41 | 1079-1082, 1152-1154, 1455, 1457, 1458 |
| 1268 | 145 | 171 | 1016-1023 | 1210 | 1 | 35 | 1431 |
| 1269 | 164 | 190 | 1016-1023 | 1211 | 30 | 63 | 1431 |
| 1270 | 199 | 225 | 1016-1023 | 1213 | 15 | 48 | 1431 |
| 1271 | 154 | 180 | 1016-1023 | 1217 | 19 | 52 | 1431 |
| 1295 | 113 | 168 | 1026, 1027, 1024 | 1357 | 162 | 200 | 1079-1082, 1152-1154, 1455, 1457, 1458 |
| 1295 | 170 | 201 | 1026, 1027, 1024 | 1358 | 124 | 162 | 1079-1082, 1152-1154, 1455, 1457, 1458 |
| 1295 | 203 | 233 | 1026, 1027, 1024 | 1359 | 130 | 168 | 1079-1082, 1152-1154, 1455, 1457, 1458 |
| 1295 | 236 | 258 | 1026, 1027, 1024 | 1360 | 137 | 175 | 1079-1082, 1152-1154, 1455, 1457, 1458 |
| 1297 | 128 | 183 | 1026, 1027, 1024 | 1361 | 163 | 201 | 1079-1082, 1152-1154, 1455, 1457, 1458 |
| 1297 | 185 | 216 | 1026, 1027, 1024 | 1362 | 130 | 168 | 1079-1082, 1152-1154, 1455, 1457, 1458 |
| 1297 | 218 | 248 | 1026, 1027, 1024 | 1363 | 132 | 170 | 1079-1082, 1152-1154, 1455, 1457, 1458 |
| 1296 | 1 | 44 | 1025, 1028, 1029, 1515-1518, 1520 | 1364 | 64 | 102 | 1079-1082, 1152-1154, 1455, 1457, 1458 |
| 1298 | 7 | 57 | 1025, 1028, 1029 | 1365 | 134 | 172 | 1079-1082, 1152-1154, 1455, 1457, 1458 |
| 1298 | 59 | 96 | 1025, 1028, 1029 | 1366 | 31 | 69 | 1079-1082, 1152-1154, 1455, 1457, 1458 |
| 1298 | 110 | 132 | 1025, 1028, 1029 | 1054 | 198 | 244 | 1492, 1496, 1497, 1498 |
| 1298 | 143 | 210 | 1025, 1028, 1029 | 1054 | 285 | 319 | 1492, 1496, 1497, 1498 |
| 1295 | 17 | 87 | 1026, 1027, 1024 | 1056 | 191 | 237 | 1492, 1496, 1497, 1498 |
| 1297 | 32 | 102 | 1026, 1027, 1024 | 1056 | 278 | 312 | 1492, 1496, 1497, 1498 |
| 1294 | 127 | 153 | 1027 | 1057 | 14 | 60 | 1492, 1496, 1497, 1498 |
| 1295 | 17 | 46 | 1026, 1027, 1024 | 1057 | 101 | 135 | 1492, 1496, 1497, 1498 |
| 1297 | 32 | 61 | 1026, 1027, 1024 | 1057 | 233 | 264 | 1492, 1496, 1497, 1498 |
| 1298 | 5 | 57 | 1025, 1028, 1029 | 1060 | 269 | 315 | 1492, 1496, 1497, 1498 |
| 1320 | 249 | 268 | 1033, 1035, 1076 | 1390 | 10 | 50 | 1054-1057, 1060, 1492, 1496-1498 |
| 1324 | 2 | 23 | 1036, 1037, 1038 | 1390 | 142 | 173 | 1054-1057, 1060, 1492, 1496-1498 |
| 1326 | 14 | 38 | 1036, 1037, 1038 | 1391 | 73 | 104 | 1054-1057, 1060, 1492, 1496-1498 |
| 1326 | 95 | 117 | 1036, 1037, 1038 | 1055 | 85 | 131 | 1493, 1494, 1495, 1499, 1500 |
| 1326 | 152 | 174 | 1036, 1037, 1038 | 1058 | 117 | 163 | 1493, 1494, 1495, 1499, 1500 |
| 1326 | 227 | 248 | 1036, 1037, 1038 | 1059 | 118 | 164 | 1493, 1494, 1495, 1499, 1500 |
| 1327 | 44 | 65 | 1036, 1037, 1038 | 1061 | 109 | 155 | 1493, 1494, 1495, 1499, 1500 |
| 1321 | 65 | 86 | 1037 | 1062 | 222 | 268 | 1493, 1494, 1495, 1499, 1500 |
| 1321 | 88 | 132 | 1037 | 1063 | 262 | 308 | 1493, 1494, 1495, 1499, 1500 |
| 1322 | 2 | 34 | 1037 | 1054 | 15 | 64 | 1492, 1496, 1497, 1498 |
| 1322 | 36 | 67 | 1037 | 1054 | 165 | 196 | 1492, 1496, 1497, 1498 |
| 1322 | 135 | 156 | 1037 | 1056 | 8 | 57 | 1492, 1496, 1497, 1498 |
| 1322 | 158 | 202 | 1037 | 1056 | 158 | 189 | 1492, 1496, 1497, 1498 |
| 1323 | 1 | 35 | 1037 | 1060 | 86 | 135 | 1492, 1496, 1497, 1498 |
| 1323 | 37 | 68 | 1037 | 1060 | 236 | 267 | 1492, 1496, 1497, 1498 |
| 1323 | 136 | 157 | 1037 | 1386 | 199 | 248 | 1054-1057, 1060, 1496, 1498 |
| 1323 | 159 | 203 | 1037 | 1388 | 212 | 261 | 1054-1057, 1060, 1496, 1498 |
| 1324 | 2 | 51 | 1036, 1037, 1038 | 1391 | 286 | 335 | 1054-1057, 1060, 1492, 1496-1498 |

TABLE 4-continued

| QUERY Polynucleotide SEQ ID NO: | start | end | SUBJECT Polynucleotide SEQ ID NO: | QUERY Polynucleotide SEQ ID NO: | start | end | SUBJECT Polynucleotide SEQ ID NO: |
|---|---|---|---|---|---|---|---|
| 1324 | 56 | 93 | 1036, 1037, 1038 | 1384 | 311 | 351 | 1055, 1058, 1059, 1061-1063, 1500 |
| 1324 | 95 | 126 | 1036, 1037, 1038 | 1385 | 312 | 351 | 1055, 1058, 1059, 1061-1063, 1500 |
| 1324 | 194 | 215 | 1036, 1037, 1038 | 1387 | 83 | 123 | 1055, 1058, 1059, 1061-1063, 1500, 1057 |
| 1324 | 217 | 261 | 1036, 1037, 1038 | 1389 | 162 | 202 | 1055, 1058, 1059, 1061-1063, 1500 |
| 1325 | 2 | 31 | 1037 | 1296 | 69 | 101 | 1025, 1028, 1029, 1515, 1516, 1517, 1518, 1520 |
| 1325 | 33 | 64 | 1037 | 909 | 305 | 340 | 1531 |
| 1325 | 132 | 153 | 1037 | 960 | 70 | 101 | 1543, 1551 |
| 1325 | 155 | 199 | 1037 | 964 | 259 | 290 | 1543, 1551 |
| 1326 | 227 | 276 | 1036, 1037, 1038 | 1305 | 180 | 226 | 1133, 1137, 1138, 1580, 1581, 1583 |
| 1326 | 281 | 318 | 1036, 1037, 1038 | 1133 | 195 | 226 | 1580, 1581 |
| 1326 | 320 | 350 | 1036, 1037, 1038 | 1137 | 52 | 83 | 1580, 1581 |
| 1327 | 44 | 93 | 1036, 1037, 1038 | 1344 | 37 | 83 | 1133, 1137, 1138, 1580, 1581, 1583 |
| 1327 | 98 | 135 | 1036, 1037, 1038 | 1345 | 228 | 274 | 1133, 1137, 1138, 1580, 1581, 1583 |
| 1327 | 137 | 168 | 1036, 1037, 1038 | 1305 | 180 | 217 | 1133, 1137, 1138, 1580, 1581, 1583 |
| 1327 | 236 | 257 | 1036, 1037, 1038 | 1344 | 37 | 74 | 1133, 1137, 1138, 1580, 1581, 1583 |
| 1327 | 259 | 303 | 1036, 1037, 1038 | 1345 | 228 | 265 | 1133, 1137, 1138, 1580, 1581, 1583 |
| 1324 | 2 | 24 | 1036, 1037, 1038 | 1039 | 176 | 210 | 1590, 1594, 1597, 1598 |
| 1326 | 227 | 249 | 1036, 1037, 1038 | 1040 | 142 | 176 | 1590, 1594, 1597, 1598 |
| 1327 | 44 | 66 | 1036, 1037, 1038 | 1041 | 248 | 282 | 1590, 1594, 1597, 1598 |
| 1328 | 3 | 59 | 1039-1043, 1045, 1594, 1597, 1598 | 1042 | 141 | 175 | 1590, 1594, 1597, 1598 |
| 1328 | 70 | 146 | 1039-1043, 1045, 1594, 1597, 1598 | 1328 | 175 | 209 | 1039-1043, 1045, 1594, 1597, 1598 |
| 1328 | 148 | 215 | 1039-1043, 1045, 1594, 1597, 1598 | 1331 | 2 | 54 | 1039-1043, 1045, 1594, 1597, 1598 |
| 1328 | 232 | 263 | 1039-1043, 1045, 1594, 1597, 1598 | 1331 | 200 | 234 | 1039-1043, 1045, 1594, 1597, 1598 |
| 1328 | 328 | 350 | 1039-1043, 1045, 1594, 1597, 1598 | 1332 | 142 | 176 | 1039-1043, 1045, 1594, 1597, 1598 |
| 1329 | 22 | 53 | 1039-1043 1045 | 1333 | 176 | 210 | 1039-1043, 1045, 1594, 1597, 1598 |
| 1329 | 118 | 140 | 1039-1043 1045 | 1334 | 16 | 68 | 1039-1043, 1045, 1594, 1597, 1598 |
| 1330 | 31 | 62 | 1039-1043 1045 | 1334 | 214 | 248 | 1039-1043, 1045, 1594, 1597, 1598 |
| 1330 | 127 | 149 | 1039-1043 1045 | 1335 | 76 | 110 | 1039-1043, 1045, 1594, 1597, 1598 |
| 1331 | 28 | 84 | 1039-1043, 1045, 1594, 1597, 1598 | 1336 | 8 | 60 | 1039-1043, 1045, 1594, 1597, 1598 |
| 1331 | 95 | 171 | 1039-1043, 1045, 1594, 1597, 1598 | 1336 | 206 | 240 | 1039-1043, 1045, 1594, 1597, 1598 |
| 1331 | 173 | 240 | 1039-1043, 1045, 1594, 1597, 1598 | 1338 | 14 | 66 | 1039-1043, 1045, 1594, 1597, 1598 |
| 1331 | 257 | 288 | 1039-1043, 1045, 1594, 1597, 1598 | 1338 | 212 | 246 | 1039-1043, 1045, 1594, 1597, 1598 |
| 1332 | 2 | 26 | 1039-1043, 1045, 1594, 1597, 1598 | 1255 | 165 | 199 | 970, 971, 973-978, 1626, 1629 |
| 1332 | 37 | 113 | 1039-1043, 1045, 1594, 1597, 1598 | 976 | 129 | 163 | 1626, 1629 |
| 1332 | 115 | 182 | 1039-1043, 1045, 1594, 1597, 1598 | 1299 | 98 | 129 | 1126-1131, 1651-1653 |
| 1332 | 199 | 230 | 1039-1043, 1045, 1594, 1597, 1598 | 1300 | 312 | 343 | 1126-1131, 1651-1653 |
| 1332 | 295 | 317 | 1039-1043, 1045, 1594, 1597, 1598 | 1302 | 155 | 186 | 1126-1131, 1651-1653 |
| 1333 | 4 | 60 | 1039-1043, 1045, 1594, 1597, 1598 | 1303 | 140 | 171 | 1126-1131, 1651-1653 |
| 1333 | 71 | 147 | 1039-1043, 1045, 1594, 1597, 1598 | 1350 | 314 | 345 | 1144-1151, 1703 |
| 1333 | 149 | 216 | 1039-1043, 1045, 1594, 1597, 1598 | 1352 | 29 | 60 | 1147, 1150, 1151, 1703 |
| 1333 | 233 | 264 | 1039-1043, 1045, 1594, 1597, 1598 | 1355 | 32 | 63 | 1147, 1150, 1151, 1703 |

Example 8

This example discloses embodiments related to polynucleotide molecules having a nucleotide sequence containing specific modifications such as nucleotide substitutions. Embodiments of such modifications include modified polynucleotides that provide improved sequence discrimination between the intended target gene of the insect pest of interest, and genetic sequences of other, non-target species.

Double-stranded RNAs identified in Table 1 were screened for sequence matches to a sequence of at least 19 contiguous nucleotides identified in a non-target gene or a non-target organism (NTO, e. g., *Apis mellifera, Bombus impatiens* and *B. terrestris; Bombyx mori; Bos taurus; Canis lupus familiaris; Coleomegilla maculata; Danio rerio; Danaus plexippus; Daphnia pulex; Equus caballus; Gallus gallus; Homo sapiens; Megachile rotundata; Mus musculus; Sus scrofa; Brassica napus; Brassica oleracea; Brassica rapa; Glycine max; Gossypium raimondii; Solanum tuberosum; Solanum lycopersicum*; and *Zea mays*). Nucleotide changes are made to eliminate contiguous sequence matches over 19 nucleotides to a non-target gene or non-target organism. Examples of such modified polynucleotide sequences are provided by SEQ ID NO:1725, which corresponds to SEQ ID NO:870 (which targets the target gene having SEQ ID NO:11), SEQ ID NO:1726, which corresponds to SEQ ID NO:1224 (which targets the target gene having SEQ ID NO:365), SEQ ID NO:1727, which corresponds to SEQ ID NO:875 (which targets the target gene having SEQ ID NO:16), SEQ ID NO:1728, which corresponds to SEQ ID NO:1193 (which targets the target gene having SEQ ID NO:334), SEQ ID NO:1729, which corresponds to SEQ ID NO:871 (which targets the target gene having SEQ ID NO:12), and SEQ ID NO:1730, which corresponds to SEQ ID NO:1187 (which targets the target gene having SEQ ID NO:328).

These modified polynucleotide sequences SEQ ID NOs: 1725-1730 are useful for designing polynucleotides for providing improved discrimination between the intended target species and non-target organisms. For example, embodiments of insecticidal compositions useful for controlling or preventing flea beetle infestations comprise an effective amount of a dsRNA comprising one RNA strand having a sequence selected from the group consisting of SEQ ID NOs:1725-1730, or a fragment thereof. In embodiments, insecticidal compositions for causing stunting or mortality in flea beetles comprise an effective amount of a dsRNA comprising one RNA strand having at least one segment of at least 21 contiguous nucleotides of a sequence selected from the group consisting of SEQ ID NOs:1725-1730. In embodiments, insecticidal compositions for causing stunting or mortality in flea beetles comprise an effective amount of an RNA molecule comprising at least one segment of at least 21 contiguous nucleotides of a sequence selected from the group consisting of SEQ ID NOs:1725-1730 wherein the at least one segment is embedded in larger sections of neutral sequence to provide an efficacious insecticidal polynucleotide. In another embodiment, segments of at least 21 contiguous nucleotides from multiple sequences selected from the group consisting of SEQ ID NOs:1725-1730 are embedded in larger sections of neutral sequence to provide an efficacious insecticidal polynucleotide for controlling flea beetles. Methods for selecting efficacious insecticidal polynucleotides are described elsewhere in this application, e. g., the method including oral delivery of insecticidal polynucleotides to flea beetles, resulting in stunting or mortality in the flea beetles, described in Example 5. These modified polynucleotide sequences SEQ ID NOs:1725-1730 are useful in a method of causing mortality or stunting in an insect, comprising providing in the diet of an insect, such as a flea beetle, at least one polynucleotide that comprises at least one segment of at least 21 contiguous nucleotides of a sequence selected from the group consisting of SEQ ID NOs:1725-1730, wherein ingestion of the polynucleotide by the insect results in mortality or stunting in the insect; in embodiments, the polynucleotide comprises a sequence selected from the group consisting of SEQ ID NOs:1725-1730. Polynucleotides comprising a sequence of SEQ ID NOs:1725-1730 are useful in a method for controlling an insect infestation of a plant comprising contacting, with a polynucleotide, an insect that infests a plant, wherein the polynucleotide comprises at least one segment of at least 21 contiguous nucleotides of a sequence selected from the group consisting of SEQ ID NOs:1725-1730, whereby the insect infestation is controlled; in embodiments, the polynucleotide comprises a sequence selected from the group consisting of SEQ ID NOs:1725-1730. Polynucleotides as described herein are useful in a method of providing a plant having improved resistance to an insect, comprising expressing in the plant a recombinant DNA construct, wherein the recombinant DNA encodes a polynucleotide that comprises at least one segment of at least 21 contiguous nucleotides of a sequence selected from the group consisting of SEQ ID NOs:1725-1730, wherein ingestion of the polynucleotide by the insect results in mortality or stunting in the insect; in some embodiments, the polynucleotide comprises a sequence selected from the group consisting of SEQ ID NOs:1725-1730.

Example 9

This example discloses additional insecticidal polynucleotide molecules with complementarity to both *Phyllotreta cruciferae* and *Psylloides striolata*. A total of two hundred-forty (240) polynucleotide sequences were engineered (SEQ ID NOs 1731-1971). These polynucleotides target gene transcripts for calmodulin, casein kinase 1a and elongation factori 1-alpha across both flea beetle species. Fifty-one polynucleotides are tiling polynucleotides that cover the transcript length of these genes. The following Table 5 summarizes these fifty-one tiling polynucleotides and the transcripts targeted.

TABLE 5

| Insecticidal Polynucleotides and target transcripts | |
|---|---|
| Insecticidal Polynucleotide SEQ ID NO | Target transcript |
| 1731 | Rpn7_PHYST-05JAN16-TRPT0002041:1 |
| 1732 | Rpn7_PHYST-05JAN16-TRPT0002041:3 |
| 1733 | TubulinG_PHYST-05JAN16-TRPT0002886:1 |
| 1734 | TubulinG_PHYST-05JAN16-TRPT0002886:2 |
| 1735 | TubulinG_PHYST-05JAN16-TRPT0002886:3 |
| 1736 | TubulinG_PHYST-05JAN16-TRPT0002886:4 |
| 1737 | TubulinG_PHYST-05JAN16-TRPT0002886:5 |
| 1738 | COPI_Delta_PHYST-05JAN16-TRPT0009108:2 |
| 1739 | COPI_Delta_PHYST-05JAN16-TRPT0009108:5 |
| 1740 | COPI_Delta_PHYST-05JAN16-TRPT0009108:6 |
| 1741 | COPI_Delta_PHYST-05JAN16-TRPT0009108:11 |
| 1742 | COPI_Delta_PHYST-05JAN16-TRPT0009108:12 |
| 1743 | sec23_PHYST-05JAN16-TRPT0011013:1 |
| 1744 | sec23_PHYST-05JAN16-TRPT0011013:2 |
| 1745 | sec23_PHYST-05JAN16-TRPT0011013:3 |
| 1746 | sec23_PHYST-05JAN16-TRPT0011013:4 |

TABLE 5-continued

Insecticidal Polynucleotides and target transcripts

| Insecticidal Polynucleotide SEQ ID NO | Target transcript |
|---|---|
| 1747 | COPI_Gamma_PHYST-05JAN16-TRPT0018736:1 |
| 1748 | COPI_Gamma_PHYST-05JAN16-TRPT0018736:2 |
| 1749 | COPI_Gamma_PHYST-05JAN16-TRPT0018736:3 |
| 1750 | COPI_Gamma_PHYST-05JAN16-TRPT0018736:4 |
| 1751 | COPI_Gamma_PHYST-05JAN16-TRPT0018736:5 |
| 1752 | Rpt6_PHYST-05JAN16-TRPT0036466:1 |
| 1753 | Rpt6_PHYST-05JAN16-TRPT0036466:2 |
| 1754 | Rpt6_PHYST-05JAN16-TRPT0036466:3 |
| 1755 | Rpt6_PHYST-05JAN16-TRPT0036466:4 |
| 1756 | Rpt6_PHYST-05JAN16-TRPT0036466:5 |
| 1757 | actin_PHYST-05JAN16-TRPT0037252:1 |
| 1758 | actin_PHYST-05JAN16-TRPT0037252:3 |
| 1759 | actin_PHYST-05JAN16-TRPT0037252:5 |
| 1760 | vATPaseA_PHYST-05JAN16-TRPT0041323:1 |
| 1761 | RpL13_PHYST-05JAN16-TRPT0045203:1 |
| 1762 | RpL13_PHYST-05JAN16-TRPT0045203:2 |
| 1763 | RpS14_PHYST-05JAN16-TRPT0045884:1 |
| 1764 | RpS14_PHYST-05JAN16-TRPT0045884:2 |
| 1765 | actin_PHYCR-05JAN16-TRPT0000169:2 |
| 1766 | actin_PHYCR-05JAN16-TRPT0000169:3 |
| 1767 | vATPase-A_PHYCR-05JAN16-TRPT0001064:1 |
| 1768 | vATPase-A_PHYCR-05JAN16-TRPT0001064:3 |
| 1769 | vATPase-A_PHYCR-05JAN16-TRPT0001064:4 |
| 1770 | vATPase-A_PHYCR-05JAN16-TRPT0001064:5 |
| 1771 | vATPase-A_PHYCR-05JAN16-TRPT0001064:6 |
| 1772 | vATPase-A_PHYCR-05JAN16-TRPT0001064:7 |
| 1773 | vATPase-A_PHYCR-05JAN16-TRPT0001064:8 |
| 1774 | tubulinG_PHYCR-05JAN16-TRPT0001496:1 |
| 1775 | tubulinG_PHYCR-05JAN16-TRPT0001496:2 |
| 1776 | tubulinG_PHYCR-05JAN16-TRPT0001496:3 |
| 1777 | tubulinG_PHYCR-05JAN16-TRPT0001496:4 |
| 1778 | tubulinG_PHYCR-05JAN16-TRPT0001496:5 |
| 1779 | tubulinG_PHYCR-05JAN16-TRPT0001496:6 |
| 1780 | RpS14_PHYCR-05JAN16-TRPT0002697:1 |
| 1782 | RpS14_PHYCR-05JAN16-TRPT0002697:2 |

Example 10

This example illustrates non-limiting embodiments of methods of testing the efficacy of insecticidal polynucleotides in flea beetles. More specifically this example illustrates a method comprising oral delivery of dsRNAs to flea beetles, resulting in stunting or mortality in the flea beetles. *P. cruciferae* and *P. striolata* were collected from a canola field where no pesticides had been applied in the previous 3 months. Two dsRNAs (SEQ ID NOs:1972 and 1974) targeting *Phyllotreta cruciferae* genes (COPI_delta and Rpt6, respectively) and two dsRNAs (SEQ ID Nos:1973 and 1975) targeting *Phyllotreta striolata* genes (COPI_delta and Rpt6, respectively) and one negative control dsRNA targeting GFP were tested on groups of 30 *P. cruciferae* or *P. striolata* by using 10 insects in three separate replications. The dsRNAs were resuspended in water and applied to 9 millimeter leaf discs (55±6 milligrams each) at a dose of 50 nanograms dsRNA/milligram leaf tissue, which were fed to groups of 5 flea beetles. Leaf discs with freshly applied dsRNA were replaced every other day, and the number of surviving individuals was recorded over a 12-day period.

A low non-specific mortality rate was observed in the negative-control insect groups (4 out of 30 insects dying over 12 days for *P. cruciferae*, or 13% non-specific mortality and 8 out of 30 insects dying over 12 days for *P. striolata*, or 26% non-specific mortality). Mortality was observed beginning at day 2 and continuing through the 12 day period. Specific mortality was observed for all dsRNA treatments (Table 6). Correcting for non-specific mortality (subtracting non-specific mortality rate of 4 or 8 insects per group for corrected N=26 or N=22), the percent mortality observed at the end of the 12 day period ranged from 36-38% for the dsRNAs tested. These results demonstrated the efficacy of the dsRNAs in causing mortality in flea beetles when provided in the flea beetles' diet and their cross species effect.

TABLE 6

Mortality in flea beetles fed an artificial diet containing insecticidal polynucleotide.

| SEQ ID NO | Target gene species | Species tested against | Cumulative mortality (days after treatment, N = 30) | | | | | |
|---|---|---|---|---|---|---|---|---|
| | | | d0 | d2 | d5 | d7 | d9 | d12 |
| | | crucifer | 0 | 0 | 1 | 1 | 2 | 4 |
| | NA | crucifer | 0 | 1 | 2 | 2 | 3 | 5 |
| 1972 | crucifer | crucifer | 0 | 0 | 4 | 8 | 10 | 10 |
| 1973 | striped | crucifer | 0 | 0 | 2 | 6 | 6 | 9 |
| 1974 | crucifer | crucifer | 0 | 1 | 3 | 7 | 8 | 9 |
| 1975 | striped | crucifer | 0 | 0 | 0 | 2 | 6 | 8 |
| | | striped | 0 | 0 | 1 | 4 | 7 | 8 |
| | NA | striped | 0 | 0 | 1 | 2 | 6 | 8 |
| 1972 | crucifer | striped | 0 | 0 | 3 | 9 | 10 | 10 |
| 1973 | striped | striped | 0 | 0 | 3 | 9 | 9 | 10 |
| 1974 | crucifer | striped | 0 | 0 | 3 | 7 | 7 | 8 |
| 1975 | striped | striped | 0 | 1 | 3 | 5 | 8 | 9 |

All of the materials and methods disclosed and claimed herein can be made and used without undue experimentation as instructed by the above disclosure. Although the materials and methods disclosed herein have been described in terms of preferred embodiments and illustrative examples, it will be apparent to those of skill in the art that variations can be applied to the materials and methods described herein without departing from the concept, spirit and scope of this invention. All such similar substitutes and modifications apparent to those skilled in the art are deemed to be within the spirit, scope and concept of this invention as defined by the appended claims.

SEQUENCE LISTING (1975 sequences)

SEQ ID NO: 1 - DNA, 959 bp, Phyllotreta atra
  misc_feature: ProsAlpha2
ttgtgtttattttatctttaccaaaaaaccgatgcagttcaaataatcaatatacacctaatgaatttcgttgaacaatgcaccgtttgcatagctcgaggtaaaaaataagaaaagaaaaatcaatgaatattaccttaaagtataaaattttatgtaccaaatacaggacaagcttaaggaatatttgccaaaaaatcttttactgtagaaggatcgaatctcctaaatccttgtggatcgcatatgccaacctcgatgttatcagcggtcatttggccctcgaaactttctttaagcgttaaaatggcggtgtgcacagcatcatccaattccaactcttcgctataccttttctcgaggaaggtcttcccgttgacgtaattctttcccattgcggtggctttccaagcgaaatacgccccggaaggatcgcactggaataagtaaggcctgttgttgtcccatccgcagatcaacagggacactccgaagggtctaactcccccggattgagtgtattcctgcatcacagtggctacacgttgaactagctgaacagtaggaattggttctttgtaaaccaggtaatactgttgggccattttacgcgcttgcttgaccaacaaacggtagtcgggtcccatcccggaatagaccattccgatgtgcttcgtgatcatttccactttgtggacgctgtgttcgtcgtaaagaatggatttgtgcttgttttccgtggctattaccactccatttgatgcttttattcctactgacggagcaccagccgctactgccgctaaagcatattcgatttggactagtttacctgaagggctgaaagttgttaaagaaaaactataacgttcagatgacattttcacaaatgattacttgcaagttatcaacaaatgtctatagaaaaattataggttagaatgtagctgacaggtgac

SEQ ID NO: 2 - DNA, 880 bp, Phyllotreta atra
  misc_feature: ProsBeta5
attacaagctacaattccgaggattacgagcgactcgcctacgacgagagcctgcagaagtattgcaccaatttcaagaatggcatgaacttagctgttcccccttttcctgatcccagcaacaactttgcaaggttcaccaaagatgataacggccgtgagatcaaaatcaagttcgaccacggtaccaccacattgggattcatgtacaaagggggcgtagtgctcgcagtggattcccgagccactggcggccaattcattggatcacaaactgtagagaaaatcataaaaatcaacagttttctactagctacaatggcaggaggcgcggctgattgcacctactgggaccgagtattagctaaacaatgtaggctgtacgagctgagaaacagggaacgtatctcggtggctgcggcttccaagttaatggccaacatggtttataattacaagggaatgggcttgtccatgggaatgatgctggctggatgggacaaaaggggtcctcaactctactatgtcgattcagaaggtctaaggacagccgggaaagtgttcagcgtaggttcgggttccatttacgctttcggggtgctggattctgggtacaaatgggacttatccgatgaggaagcttatgatttaggtcgtagatcgatttaccacgctactcacagagacgcctattcaggtggtattgttagagtgtaccacatgaaggagactggctgggtgcacatcgatgataatgattgcatggacttgcattacaagtttgtggaggaaaaggagaagatgggtggcgcttgaattaatttgtgaatttatattttttaagagtaataaatttcttttaataaatgcttgataagga

SEQ ID NO: 3 - DNA, 720 bp, Phyllotreta atra
  misc_feature: RpL19
cttcacctttatgacattgacagttcctaacgcagccatatttctttttcggatacacgttgttaagagcgtgtgaaaaatgagttcgttaaaactccagaagaggctcgcagcctctgttatgagatgcggcaaaaagaaggtatggttggatcccaacgaaatcaacgaaatcgccaacacaaattcacgacaaaacatccgcaagctgatcaaagacggtctgatcatcaagaagcccgtggcggtgcactcgcgcgcccgcgtccgcaagaacaccgaagcccgcaggaagggcaggcactgcggtttcggtaaaaggaaaggtacagcgaacgctcgaacaccaagaaaagaattatggattcaacgtatgagggtgctccgtcgtttgttgaagaagtaccgcgaggccaagaaaatcgacaggcatctgtaccattcgctgtacatgaaggcgaagggtaacgtgttcaagaacaagcgcgtcctgatggaatacatccacaagaagaaggccgagaaggcgcgcgccaagatgttggccgaccaggcgaacgccaagagaatgaaggtgaaacgggccagggagagacgcgaagaacgtatcgctacgaagaagcaggaagttttgcagaattaccagcgggaagacgaagctgccgctgctactaaaaaataggttattcttttttcatttgatgactaataaaaagttaa

SEQ ID NO: 4 - DNA, 1434 bp, Phyllotreta atra
  misc_feature: RpL3
gtgaattagacatgttgctggtgacgttttactttatctgccatttcatttttcgacgtcaacatgtcgcacaggaagtttagtgcaccccgtcacggatctatgggattctaccccaagaaaagatcccaaaggcaccgtggtaaagtaaaggctttccccaaagatgacccctcgaaacccgtccatttaacagctttcattggctacaaagccggtatgacccacgtgctacgtgaggcagacaggcctggttcgaaaatcaacaagaaggaaatcgtagaggctgtgaccattttggaaacccctccgatgattgtagtaggcgttgtgggttacatcgaaactccacatggcatgagggctttggccaccgtttgggctgaacatttgtctgaagattgccgtagacgtttctacaagaactggtacaagagcaagaagaaggccttcaccaaggcatccaagaaatggaccgacgatttgggtaaaaagtcaattgagcgcgacttgaagaaaatcgtcaaatactgcaaggttgtcagagtcatcgctcacactcagatgaaattgttgaaacaacgccaaaagaaagcccacattatggaaattcaactcaacggcggtaccattgccgacaaagtggcatgggctaaggagcatttggagaagcccattcccgttggcaacgttttcgctcaagatgagatgatcgattgcatcggtgtaaccaaaggtcatggatacaaaggtgttacatctcgttggcatacgaagaaattgccccgcaagacgcacaagggtcttaggaaagtcgcctgtattggagcctggcatccttctcgagtgtcgttcactgtcgctcgtgctggtcaaaagggttaccatcacaggacggagatgaacaagaaaatctacagaatcggcgctggaattcacactaaggacggaaaggtcatcaaaaacaatgctgctaccgattacgatcttagtgagaaaactattacaccgatgggtggtttccctcattacggtgaagttaacaacgacttcgtcatgattaagggttgttgtattggacctaagaagcgcgtcattacactgagaaaatctctcttggttcacactaagcgtattgctttggagaagatcaatttgaaattcatcgatacgtcgtccaaattcggacacggtagattccaaaccgccgccgacaaggctgcgttcatgggaccccttaagaaagatagagttaaggaagaagacaagactgcggctccagctgcagctgctgcttcgagttaatttttatgcaatgtattttattgttgacaatatacattgattcagagtatttatttttgttataattttatttattgttaccctctaatgtgctgtatttcattaattaataaaatggatgcatttaaa

SEQ ID NO: 5 - DNA, 691 bp, Phyllotreta atra
  misc_feature: RpL40
ggaaggagaaagaaaggaaaagatacaagatacgccattttgtgtctagtgtcgtaaagagaaagttgtgaaactaaaaacagctgttctttcatatcaaacttctgaaaatcattaaagaatgcagatcttcgtgaaaaccctgactgggaaaaccatcaccctcgaggtggagccgtccgataccatcgagaacgtgaaagcaaaaattcaagacaaagaggggatcccaccagatcagcaacgtttgatctttgccggcaaacaactggaagatggaagaaccttatctgactacaatattcaaaaagaatctactctacatttagtacttcgtctccgtggagggatgcaaatattcgttaaaacccttactggtaaaactataaccctcgaagttgaaccatctgatactattgagaacgttaaggcgaaaatccaagacaaagaggggattcctccagatcagcaacgtttaatcttcgccggtaaacaactggaagatggcagaacattgtctgactacaatattcaaaaagagtccacactgcatttagttcttcgtctacgtggaggaatgcaaatattcgttaaaactcttactggtaaaacaattactcttgaagttgaaccatctgatactatcgaaaatgttaaggccaaaattcaagacaaagagggaattcctcca

SEQ ID NO: 6 - DNA, 689 bp, Phyllotreta atra
  misc_feature: RpS21
ttttttttttttaaccttagaagatagtttatttattagaaaagtttaaattacattttctgaatgatttaacgaagttgtgatttagaagtttttggctaagattccatctttcttcgttaacctcacaatacaatcgtccgattctcccatacgcctgatagctccgcagagggcgtagcttttggaactttcggtcatccttccggttaaaggatcgacatcggctacgctgagttgaatgctagcgtggtccttagcatgaataattctgttgctagcagagcatttccttgggcagtacaagtcgacggtttcaccagcgtcgttttccatgttttatatgattgttataaaataacacacaagaaaatggatgaacgtcaaaaaagaaaggagacaatgttgccaacctgtagttacgaatttatttctttataaatttattttcatagagaaagaaatatgagagagttcgacgctgtactaaaaattggcatagcgtttgatgatcagcgctgcatgcggttcccgcggcttaaacgtgaactaagcaaggttcgattatgtagatttcttctgagtttctcaaaatcaaaaatagggggtaaatttatattttaattataaattggattgtgaaaattataaataaaaattacaacttttgttaattttataaatgtatt

SEQ ID NO: 7 - DNA, 591 bp, Phyllotreta atra
  misc_feature: RpS4
ggttttatggatgttatcaccattgagaaaactggtgaattcttccgtctcatctatgatgtaaaaggcagattcgctattcaccgtattactgctgaagaagctaaatacaaactgtgcaaagttaagagggttcaaactggtccgaaaggaattccgtttttggtgacccatgatggacgtaccatccgttatcctgatcctaatatcaaggtgaatgacaccattcaactagagatcgctacgtcgaaaattctggattacatcaagtttgaatcaaacaacttgtgcatgattaccggaggtagaaatttgggacgtgttggtacaattatgaacagggagcgtcatcccggttccttcgatattgtacacattaaggacgccaatggtcatgcttttgcaactagattaaataatgtattcgtgattggtaaaggagctaaagcctttgtatctcttccaagaggtaagggtgttaagttgtccatagccgaagaaagggataaaaggctagctgcaaaaacacactaaacatgtgttaatattattttcaataaaacttgcgaaaagtgttaaaaaaaaaaaaaa

SEQ ID NO: 8 - DNA, 3291 bp, Phyllotreta atra
  misc_feature: Rpn2
gcgtattttattatcatatgctcaacgatggcttatttataaaaatttatcgaagattacagcatacaagaaatatatgaataaataattcaacactgtatgtaaaaaaaacatcttaagctgaatgaaaaaaaccaagtttaatatttagattttagaaataactagtgaatttctctaatcctcggtccattcgaatggttctggtggttctggttccttttcatcatcgccctttggaccgaatgctgctacgggttccaccaattcctcttcaccaggtttcaaattgcgaaccataataatccctccgatcgaaacatccttcattgcaacgtattgcgagttatcattaagcgtaatcactttcagctgttgcctcatggtcctggcaggattttgcaggatttcgaaactaggctcgggctcctttttcttctcctccttatcatctttcttatcttttttgtcgtcgctcgacgacgccgcttttttatcgtcggttttcttatcatcggactttttctcctctttcttctcttcggttttcttctccttctcctccttctcgggcttcttatcgtctttatcttcgtccacatccattttctcatcgcgatgtttcctctcgtgatcccttctcctttgcctggcagctatactcaatacggcagtggtgactttctccctttcttcgcgtttcttttcctccatgggcgccgggtaggcgtacaagctcggcttcgcgttcgatttgaactccagtttaggcatcttaagttgagtgttcaacgctataacgcacgtcggggtaaaggctaaagccagacaatgtgacagagggaaccaataccaatactgcgtaaacaccaatgtaccgacaacggccagcatattagtgtggccagttctggattgcaacgatagagtcacgttcctgccaccggcgtcgattataccttgcgccaagatggcgccgaacttcgccatgacgtcttcgtgcttgttggagatgacttgggagtaggtctgcctgaagaagctgaccttcgggcaggtctgctcggtctgctggatgaggatcatcgcggaggcgatgagggccccctgccggacgaagttcaccggatcgaacatcaccatgggctcgagcagggctatggcctcgcgaaggcccgtgccggcgcaggctatgcccagcgccatggcggcgccgtaacgtacgtgggggttgtagctttccgctaacagggacaccacgctgggacattgctcgggggttctgaacaacaggaaaccgagcgctgtgactgccgctcttctcacgtcatcgtttacatcagaaaccgcaacgtgtaataattttctaatcgcctggttgtgtcccgtgccgcaataagccatagctaatgtatacatgccggatcttctcaggattggatccttatcagaagtaagctgttgtattagggtatcagcttcttctaatcggccgtacatcgtgaagcttataccaacagccaaaccgcgaagaatcttttcgtgttgactctcttgcgcgtacgctaccatatccataatcgtagtggaattactggatcctaacataaccatgcccatcgcaattccagcggcctctccggtattagcatcatcttgatagagattgaacttcagctgttcgtagacatcttgcctgtgtgtccccatggcagccaaaccaagccctaaacaaccgccgtgcctaaccatctcattctgagcgtctttcaattgaccgagaagataatcgattatattagcaccgtgattggcgtgtataagacccagagcgtataaaccaccgccttcggaatatccggaactcggcccgacttccttcggcaaatagctttgcatgagtgtcaaagcctcttgttcgtgtccacggtggatgacgccgagagacgctgttgctgtaagtttcgcccaattcgtagctcgagctagccattccaaattatcccttagaaattggtcgctggtagtaccgctgtgcatgaaagcgttagcgatgactgtagcagtgtggcaaatactaactcgaaccgtttctttggtttgcttcagaataagaagatcggcgtggttagatctaatgaggaattgaagatgaagttctattgatacttcgccggataggatggtatgcaatttttcaattcgcttttggtgttccttttcactttcagtcaaactctcaatagatttttcttcctttttagcctcgactttagtttcgctgctaaccggatctttgctagcctctgccgaagtgctactagattgttcagtagctttagctttcaccttttcctctaacagcgatggaatgggagcagtagctctaagggcaaccaaaactctttccaaaaactgttgggttgcagactcatacagatcgaaagctatttggtaagccatcaattcggactcttctttaccagacactaatttatccaaaatttctgcgactggcagtgcatcgtccaagaaaattagacattggcacatgttaacgtaatccggtgtagttaaaccgcgatacaagccaaccaacgatcttaaaacggtgttacgaaatgccctattctgaattaggctcatcgccacttggaaagcgtaggtgagcatgctaataatatcctcggcttgtgtgatagataattcgaagatgtccattctcctggtctctaaggcgagccccatagcctggcggttttgaccatcatctaaacaacgttggaacattcgatttacaatcgcttcgagtctcgaatcaataggtttcgcatcggttgcgccttctgccaaggcgatgcgttgttgtgtatagaagtcgatgcattttgcaagagtggtttcaacatattctgttctagcatttacgtcgaagagatcaccagctcccaaagcgtacgttaacgagtcttcgaacgcacccagatggtagtatactttactagcgactaaagcagctaactggtgttgttgaaacactttgtcttcgtgcagaatttctatcttttcaatagcttctgaaatttctggccagaattcgtcgactatggagtctagttttcttaacgcgaatactttaagttctggtcttggttcttctaaaagggatataatccccgcagccgaagtaatattcatcctttaagcgcttgaaaatatctcaattaaattttcagcaccagcacaaataaaaatttttaggaagtaaaatgtcaaaattgttttctgtca

SEQ ID NO: 9 - DNA, 1321 bp, Phyllotreta atra
  misc_feature: Rpt6
tccttctgcatgaccttggccacagccatttcgaaatcttcttgggtaacgtgcacccttctctctcttaacgcgtacataccagcctcggtgcaaacacccttcacttcggcaccgctagcgcccggcatcaattcggcgattttcctcagattgattcctctggtcaaattcatttttctagagtgaattttcaggatgtccaatcgggcttcctcgttcggtggcgggaattcgattttcctgtcgattctgccgggtctgagcaaagccgggtctaaaatatcgattctgttggtggccatgatgactttaatgtttttcgtcgcttcgaatccgtccaattgattgagcaactccaacattgttctctggacttcggaatcaccgcccgaacctgattcgatacgagaagatccaatagaatcgatttcgtccatgaaaattatggaaggtgcgtgttctctggccataacgaaaagttctctaaccatcctggaaccttctccgatgaatttttgcaccaactccgatccagatacacgaataaacgtacattctgtatgatgagccactgctctggccaaaagagtttttccagttcctggaggaccgtataaaagcacacccttcggttgagcgatacccaaggcatcgaaaagttcaggatgcttcacgggcaattcaatgacctctttgatttcttttatttgcttgtccagaccaccgaccatttcgtaagtggaatccggcactttttccaccatcataagagacactaaaggatccaccttattcggtaaaattttgtgcaaagtgtaagattcatttcgaagagcaactctacaattgggtgtgacatcgttaatgtcgatattcttatcgatatcgaccacaaattttccctccggatgaactttgacgaggactttcttcttgtccatcggttttactacttcacctacgtagcttccttgttcttgaagcaacatcagttcttctctaagcatacgaactttggcgttaagttcgttcctttgggcctgcaatcttcgaaggttttgactcttttcggcaacgataagttgcaattcttcgattttcgtaatgtaatacgacctgaagccttcccccttcaggcctccgtcgacctccatcttattgataacagtcatcgtcggtttttaatcgctcgatagttattagagcaatttttctatttgattcaataacaggaaacaccaaacaccatataactcggcaaagtgaaattccgaaaatcatttaatttgacttttgacacttgcgtgacgtaccagac

SEQ ID NO: 10 - DNA, 2552 bp, Phyllotreta atra
  misc_feature: sec23
cgcgtaaccttgaaatttgatagaaaagtcaaaagtcaaagtgcaggtgatcacgtatttactatacataacttttatttaatctcttttaaaacggaaacaatattttaaatcacgagttaatatcaagtttattgcatgctttaatttggcgaagacacgtaaaaaaaatgggtaacaggtcttcacttctgcttcgcgaagaagaaattgctcaaattcaaactgaaacaggctttacgccgaatcaaatcgaaaggctgtattcaaggttcacctcactggacagaggagactgtggaacactgagccgagatgatttcctgcggatacccgaactggcaattaaccctctgggcgaaagaatcgtgaattcgttcttccaaaacgacgatttcaacgacagagtaaatttcaggcaattcatgcaagtcctcgcccattttatacccatcaaaaagaacaaggaaaacaagctgaattctcgagaagagaaattaagatttgccttcaaaatgtacgatttggacaatgatgatatgatttcgaaggatgaactgttggccatattgcacatgatggtcggaacaaacataagcgaagaacaactgaacagtatcgcagagagatcgatcacagaagcagatgaagacggtgatcagatgatttcgttcgaagaattttgcaaggcgctgcaaaggactgatgtggaacagaaaatgagtataagatttttaaattaattgcggaaatcatgagtaaatcaggatatgtaaaacgcttaaaaattcttttaggcaatactctatattttgtgatagataaattatttattatgtaagtttattcgggaaatggtagttacctcacggttgtggctgtaagttatacatctgatgcatttttaggataaaggttttaaaaacgtcaaccgtttacacttgttttattcttattccatttaataatataatttgttactcgatgattttctaaataattcactttcattggatacattaaaatgtgtaaagtgaatgtagcttatcacaaacaaccaacatctgaaaatctatgaaataaatacataaaaaaatatttaagcttaaaattcatacaatttttttagtttgattagcaattaccacttaagccgtggacgaaactgccaattttttcaaatgatccataaatacttgaagtgatacatcgtctgttaaaaccggagcgccagcgtcccctccatatgaatacatgttattgtgagtctgactcggattgactttggacaataaaaatctagcctgcgatcctccttgttcggtatcgatatatctcggcatgggaaatctcgtttgtaatatctcttgagcatcgtccacgggcgcttgcaaaagttgcctaaagttttcgtattcgggcatatcctggtacttcaaatttcgccattgcgctatagtctctccgtggaatatcaaaatttggaaaaacgtgtccataagcagtattctatcgggctgtatggaactcgtatctaatagaacaggctccggagggccgttgaaactgtaactgtacaaaattggttgaatcatgatcaatgattgagtaagatcttctctcatcagcatatgtcgatagaacgacgtttcatcaggagaattattgaaaacttgcaggaactgagacctccttagatggtacatgaattgcggatagaggctaaagttttggcccaatctgaatgaaccagcatcgtctttattgtattctccgaatttttgacacaatcgaatcagcattctatcgacccatctcagaacgtcgggactttcatctgattcagctctataaacagccattctggccataattacagctgctgcttcttgatcaaaaccagcgctgatgtggtggatattagtagtggcgtcagcccagtttcgagccactgttgtcactctaattcttctttgaccactcgagtgttgatactgagtaatgaattgtatgcaacctcttcctccttgcggaatcggtgcagaatgctgattgacgacttcgaagaacaaggccatcgtagtgcttggagtaagcgtacacattttccattgtacagtgttgcccatgccgatttctgtgtcggagaccagttgacttttgacgtttaatgatacacaggatccaatgcctccttgcacttttaattctcgagaacatttcacttctaatgttccgttaaaagccattttcaaatcgtttttctgatctctggtaaacactctttggaacgtttgtttgaacaacgaggaattgaacgagtctcccatcaccatatgacctcctgtagaattgacgcattgcttcatttccatcaaaccagtttgatcaagagcgcaggaatagatgtcaatacaatgaccgttagtcgccgctctcatagccagagtatcgtaatgtttaatagcttttttcatgtatttcgcgttatctttttggatgtcatgatgggatctaataggttgtttcaaatcgtcattcaaaacttgacc

SEQ ID NO: 11 - DNA, 2471 bp, Phyllotreta atra
  misc_feature: sec6
aaaaaatgtctattttgacattaaagaatgaggttaacgtaaaaaaatcctcatagatatttgtttagaaaattagttatcaattaatagaatctacaaaatgactacaaaaaaaattaatatgagagagctggaagctactgctaaagcctcaggaacagccaaagtcattaacacattaaataggccaggccagttagaaaaaatcgaccaaattaagcaaaggtatgttcgaaaaaaagcatctgttgaagcccttctgaaatcggcaatgcaacagcaattggacggggttcgaactggattggtgcagttgcatcgatgtctcgaagaagtttgtgaaatcgatgatagtatgaagaaaatgtctgaattgtttgccgacgtgcctgaactcagcaagaagcttatcgatattagagatgaaaatatgcgtcattcacaatacgtaacagctaaagaaaacctcaagcatatttttactgttccggaaagtgttgagaaaacgaaagcttggattaacgaaggaaaattgcttcatacacatcaatgtttaagggatttagagaactcgagagacgacctactatttgagttacacaaactaccaaatcaatctgtgcatgacaaatcgatgttaaaagcatatttcgccgatgtggaagtactatcgaaattattggagaagcaactaacgttcattttatctagaaccttaaatacagtaagaaaagacccgacagtaatcgtaacagccttgcggatcatagaaagagaagaaaaagcggacgaagaagctttaaagcaacaaaaacaaactggattcattcctccagctcgaccgaagaaatggagagaaatggcttttaaaattttggagaagaccgtgtcatccaaaatcgagggtactcaagttgaagaaagagaggacaataaacattggcttatacgttatttagaactaattagaatgatgatcttagaagatttgagaattgttaaaacactctgtcttccttgttttccaccaagttacaaaatattagacaaatacattcatatgtatcatggtggtctttctgtacatctacaagaaattatacaaaacgggctcaaaggtaacgaatacgttacaatactttcttgggccttgaaaacgtataaatcaaaagacatgttgggccatccagatctaacagcttcaactgaaagtttacctcctttattacctaaagccgtgctagaccatttggaaggagactatttgaaaaatatcgaagggaattacagtgaatggatgcagaacactctcaaatcagaaaaagaggaatggagatcaaatactgaaccgttctcagaatcgtattctcggacaccggcccccattattatatttcaaatgattgatcagaatttgcaagtagccaaaacaataagtgaagaattaacaataaaagtactaaatttaagcatccagcaagtaattatatttgcagatgcttttagagaagcgattatcgaattcaagaataaatattttgaagacaggaaacaagttgtatattttactcaatacatgatcttaattatcaacaatatcctgcaacttgttgaattaggttctcaattggaaaaagaatatgttactaacaacagttcgcatgaacttactaggaattttggagcattaaaagcgacttatattaaaatgagaaacgaggcagtccattatctcttagaagaattatttgtcgactcggaccaacatttcgacaaactgtttacatcacattggttcgcttccaatcctgcggacacaatttatgtaaccatcgaagattacttccaggattacaaccgcttagtggaagcgaattacaaatatttaatcgagcaattaattacctccgtcggtagaaaatacctcacagccatgctgtccaggcgcatatcgtttaaaacttacgaagaatgcacgaaagcagcacaaaaagcgtcggaagaggccaaccgattgaacagattgtttcagacccttagcaaagacatcgaatgcgaaaacccattcgatgccatcattatgctctcggaggtattgaaaagtgatgacgatatgatgtcgtttgagcttcacagagtcgtggaaaaatatcccgatatcacggatgatcatctcctgaggttgctaaatttgagaggcgatctatcaaggtctgaagttagagacaaagttgcgcatatagataaacctaaagttctacacaaaagtacgatttttaggactttgttgtttccaaaacttgtaaatatcaatttgaacttttaaaattgtatatattttaacaatattaatgctcacgccatttttatttatttcattccatcctgtaagtctgtgctagactttataaaaataaatcattgtattataataaatgattgtcacacataatatgtacaataaattgagg

SEQ ID NO: 12 - DNA, 1356 bp, Phyllotreta atra
  misc_feature: shrb
gagcaattccgcaccagccagcgaacaaaccgatgaaccctctatttttgatggatgactaataacagtgaaataaatatcaaaagtgctgctcggtttttcgtagttttcccttatttccattggaaaaatgagtttctttagtaaaatattcggaggaaaggaaaaagacgagggccctacgcccggggaggccatccaaaagctcagggaaaccgaggacatgttatataaaaaacaagagtttttagaaaagaaaatagaggaatacactttagtagccaaaaagaatgcatcgaagaacaaaagagtggcgcttcaagcgctcaaaaagaagaaacgattggaaaaaacgcaactacaaatagatggaactcttacgacgatcgaaatgcaaagagaggccttggaaggagccagcaccaacacagccgtcttagactccatgaggaacgccgctgaggccctccagaaggcccacaaaaacttgaacgtcgatgatgtccacgatatcatggacgacatagctgaacaacacgatattgccaatgagattacaactgctattagtcaacctgtgggcttcgccgacgatttggacgaggacgaattggaaagcgaactggagaaactggaacaagaaggattagaggaagatttactgaaagttccgggtcctactgaattacccgctgtacctacgggggctatcgctaaaccggttaaacctgctgctaaaaaagtggaggatgatgatgacatgaaggaattggaggcttgggcttcgtaaggattgctcgaagtggtaacacgcgtgaaatggaacacacaaaaaaaatattgtagctattaacggcttgtttttttcggcttcaaggtttaggcgttacatctacttttctgataggtatatttcaaatatttgaagtccctcttgttatttttaattaactttaaatagtaacgatttattgtctatttttgtaatataagtgcaaatcagatatactttaatctccaattataaatatttgattatgtatcaataaactgtacaaaaagtatttgtttaatttgtcattacatattaatttggtatatctgatttacgaattaataaagaggataatattcacatacttattaggcagggcaattaattaattaaataattaacaacatttagctaaatgaatatgtaacttctttttgtacagatttaaagtattttgtaattgcacttaggtgatgttcaaaataattcgattagctttaaaagtactaaatgcatattgttcgttgttaaattgtataaagttcatatttgtagtaaacaattatctttttaaaaaaaaa

SEQ ID NO: 13 - DNA, 2859 bp, Phyllotreta atra
  misc_feature: Vps16A
tttttagcgatttttaataccaaattaacgaaaaagcgacgaaaaactgaaaatgtcggcggcaatgttgactgcagaatggtttcttttaggaagagattcatattacaggaaattcgaaatctactccatgtcatggcaaagggaggaaatcaatatggaatcgcttactttttccacggcctcatacggtggtcccatagccaccagaaacaatcgacagaaactgatcaaagtacaaggcggtcatcaaccaatcgtttccgtttattccgcatcaggaaaattcatttcctcctttaaatggactaaacgacccatcgtcaaaatgggctggactaatagggaagaattgctgtgcattttggacgacgccaccgtggtcaaacacgacatgttcggtaaatacctgcacgccttcaacgccgtcggcaggcaaaaggacgtcaaagtgacggacgctaaaatcttcactaattgtcacaatttgacgggcgtcgtcgtcatgacgtccgattggaaattctacgctgtcaataacgtcgatgaaccgaaaagtagacggttgtcggagttgcccagatctgctatccagcctactggttgggcgattgtttctgatgacaataggacggagattttggtggctagaagcttggaattgtacaggttgaaacaggacgaagatcgaaccagttcaatgctggaaccggatataacgaacaaatacacatctataatcaaaatgtcggtgtctttaaacgctagacatttggctttttacacggattccggttttttgtggttgggttcgacagatctgagaacgaaatattgcgaaatcgattgcgattttgttttcaaaccgaaacaaatgttatggtgcggtaacgaagccgtggtcatctattgggaaaaagacaatacgttaatgatagtaagcaagcacggtgaaaaattgaaacacttttacgagtcgacggtgcatttaacgccggaagtggacggcgtcaggatactgtcgaatcaacaacacgaattcctgcaaaaagtaccggaagtggtgcaaaagattttccgaataaacagcaccgaaccgggtagttttttgttggaggcttccaagcaattccagaaaggcagccacaaagccaacgaatacgtttgtttggtgaaaaacgatctggaaacggccgttaatcaatgcatcgaagccgtcagttatgaatttgacgttgacgttcaaaaaatcctactgagagctgctcaattcggcaaatgtttcgtgccgacgatgaagtccgacagttacgtcaacatgtgtcgaattttgagggttttgaacaacgttagagacccgaaaatcggaattcccatcaccattactcaattaaatttcacgaaaaccggtcgatcgtcgatcctcgtacgactcatcgccaggaatcactattatctcgccctgaaaatttcggaatatctaaaactaccgcccagggagggctccacgtatgttttggtgcattgggccaaacataaggtcggtcaaagtcgactcgacgaggagacggtcgccagagagatagccgccaaattgggcgaaaagggtagcggcggcggggtgagttttagcgaaatagcggcgacggcgtcggagtgcggcaggaaaaagttggccatcaagcttttagattacgaatcgaaggcgagcgatcaagtgaaattactattggaattgggcgaaaacgtgccggctttggtcaaagccatcgaaagcggcgatacggatttagtttatactgtcatattgaaattgagagaaaacatgcctttaggggactttaagatgaccatcagaaatttccctatcgctcaatcgctgttcataaaatactgtaaagagcacaacgcgcaggctctaagcgaaatttacattcaagaagacgatttttgcgctcaagccgaacttttcatcaaagactcgctggatgttaagaaaaaccacgcgaaagacgcccttttgtcgtcggccttggaggcgtacaaaaaatcccgcaaagacctcaacgccaccatcgtggaggaacacctgcgcttgtgcaggttccaaagggaattggaggatacgctgccggaggcgcgaggtggaaaattcgccggaaaatccgtacaagacacgtgtaaattactattggaattgaacgaaaccaaattggccgaaaagtttcgcaacgatttcaaaattcccgataaaagatattggtgggcgaaaatcgccagtttggccgatcgaaacgattggatcgaattggagaagttctccaaatggaaaaaatccccgatcggctaccatcccttcgtcgacgtttgtttggcgcacgataaaccgcaggaggcgttgaaatatttacacaaagttggcgaggatgtcaaagtcaaatattacatcaaagcgggacgtttagaggaagcagccgaaatagcctatcaacaaagggacgtccaaagtttgttgtacgttcagggaaaatgtcagggaaatcgattttccgacgaaaatcgacgacgattgatggagaaaatcgcccaaatgatcgcccaaatcgaatcgaaaaaataaaaacccggaaacatcaaaattcaatgattaaggggtgaggtacagttaaaacgccaaaaaatacgttttttttgataacatatttaaatatttcttatataaataatacatacagggtaaaccaaaattcagtgcaaagatttcaagggcatatttaccagccaaaaataagaaaattttttcatatagtcgtatgtcctaacttccttctgttccaacatacagggtgtcaaagttta

SEQ ID NO: 14 - DNA, 1131 bp, Phyllotreta atra
  misc_feature: VATP-E
tgatattttaagttttttgtgggttgtaacgaatattatctaataatgtttgtgcaattcgatgaaaaattgcaattaactagacaaccaattaatatagaatcaccccgtttgtttcattctacagaaaaaacctttctttttaattattaaagaatccaaaacgttcgaaaattgcgtagttaccaaattattttcagttttttatgggttgaatcgaaattaatactaaaaattttaatccattaagtgtacttttcattacatcctatttgaactatctaaagtactatattgaaaacccgataatcttatattgcagtgtaatttttacagaaaaaaacatcctatgtacatgcattacaatcgcctcccaatatttcttcaattaaaatcaaaacaaaaccggaacagcaaccgcaacattgcaatttaaaaaacaaaaacaagtttcacagaatattaaaatatacaaggaatgatacaatagagcaacgaattaatcctaaacaacatcatctgatgataacattacaataaattttataaatcgaatactattttatttcgaccgatgtaaatattatacgatcgcacaaaccccaagcaacctaatcggtgaatttcctgttcacgttacgcccgaacagagcgttacggatttgaggcaccaattgctgcgagatcaagtccaatcgcgcctccagcgtgttgttgatcttcactttgttcttcaacgccagcaaatcgatcccccccgtagtctcctgcgacaagtgcgactcgtcgtcgatcttcaggtgcacctccttgcccgttatgtccttgtacttggtctgcacgttgcccagaatcgacttgaccagctccctgtcctgcgggcgcacgcgcaccgttacttctttctcgaacagctggtagagtccttggaggatgaggctttcgatgatgtggccgtacttcccttggtctttggtgacttcgccgagtcgtttgcgggcgtcttccagcacggaccgaacgtggtcctctctcactttcaacaccttcagtctggcctggttcagcatgttggacgattggattttcttctggagttcgacttgtttctctttcttctcgtagtattcc

SEQ ID NO: 15 - DNA, 2566 bp, Phyllotreta atra
  misc_feature: VATP-A
agcaaatatggtccacgtgaaagtattgaatttgataagtttatcagttatttgtcagtcagctgacttatcttgtgacaagttgtggattttaagaaaatcgtcgatttgctgtacttgatagttcagtgggtgaggttgaattagaaacatcacgtctaatcgccctcgttttcagaacatccacaaaaatgtcgaaagtacgtgttggagacgaagaaaaagagagccagtatgggtacgtccatgctgtatctggtccagtcgtcacagcagaaaagatgtccggatctgctatgtacgaattggtacgtgtgggctacttcgaattagtcggtgaaattatccgtttggaaggagatatggcaactattcaggtctacgaagaaacttccggtgtaactgtcggtgatcccgtgttgagatcaggaaaaccgctatccgttgaacttggtcccggtatcatgggttcgattttcgacggtatccaacgtcctttgaaagacatcaacgttttgaccgaaagtatctacatcccgaaaggtatcaacgtacctgcgctatccagaacagcaaaatgggatttcaaccccattaacataaagttgggttctcatttgaccggtggcgatatctacggtatcgttcacgaaaacacgctggtcaagcacaaaatgcttcttccacctaaagccaaaggtaccgttacgtacatcgcagatcctggaaactacacagtagacgaagttgtgctggaaaccgaattcgacggcgaacgttcgaaatacactatgttgcaagtatggccagtccgtcaagccagaccggtcagcgaaaaattgcccgccaatcatcccttactcaccgggcaacgtgttttggacgctcttttcccttgcgtacaaggcggtactacagctattcccggtgccttcggttgcggaaaaaccgtaatttcccaatcgctatccaaatactccaactccgacgtcatcatctacgtaggttgcggagaaagaggtaacgaaatgtctgaagtattgagagatttcccggaactcagcgtggaaatcgacggtcacaccgaatccatcatgaaacgtaccgccttggtggccaacacctccaacatgcccgtggcggcccgtgaggcctccatctacaccggtatcacgttgtccgagtacttccgtgatatgggttacaacgtgtccatgatggccgattcgacctctcgttgggccgaggctttgagagaaatttccggtcgtttggccgagatgcccgccgattccggttacccggcctacttgggggcccgattggcctcgttctacgagcgcgccggtcgcgttaagtgcttgggtaaccccgatagggaaggctctgtttcgatcgtaggagcagtgtcgccgcctggtggtgatttctctgatcccgtcacttctgctactctcggtatcgtgcaagtgttttgggggttggataagaaactcgcccagcgtaagcatttcccgtctgtcgactggctcagttcttactctaaatacctgagagccttagatgatttctatgacaaaaactttgcggaattcataccgctcagaaccaaagttaaggaaattcttcaagaagaagacgatcttacagaaatcgtgcagctggtaggaaaagcttcattggccgaagctgataaaattacattggaaatcgccaagctgttgaaagaagatttcctgcaacagaactcgtactcatcgtacgacagattctgtcccttctacaaaaccgtgggtatgttgaagaacatgattgggatgtacgatatggcgagacacgccgtagagtcgaccgctcaatctgagaacaagatcacgtggacggtgatcagggattcgatgagcaacattctgtaccaattgagcagtatgaagttcaaggatccggtgaaagacggcgaggcgaagatcaaggcggatttcgatcagctgtacgaggatatccagcaggcgttcagaaatctggaggattaattcgtcgcagatatgttaggatttctctttaaatttttcagcagtgtaagttttaaagaaaaaagatagagataatatcaaatacaataaataattaagttaaaagtaagtcacctgtccctcaatttaataattaattgatgagccattttagtagcagagacggttggttgatatatattaccatgtaaaatattttatgtaaattgttgaatattgtatagttttttattggtgagggtacagtgcttataaatatttaaaaaattattcctgtcattccaatttattattattaagttcttcctttttttcatatctttttttaaacaggtgcttaattgtcatttatattcagtattaggtttttctttttttgattgtgtaaccctcctggtatcatcctcgtcgtttttatttacaatctgttgtaaaaaagccacgttcacttctattttatcaaacaattgtacagtatatcgtgaattaataaaataaaatatcgtgtattgtatcttattaatcgcagttaa

SEQ ID NO: 16 - DNA, 2429 bp, Phyllotreta atra
  misc_feature: COP I beta
accggctgcggcttctccaccaacttcaaatcgcccagcgtcgccaactccagcgtgcaattctgcagcgtgtcgctcgtttggttcaccaccaacacatccagcacgatatcgtactgattaacgtgcacatacgcttcggagtaaacaggatccgagaaacccgtcagctgggctattttattcaatttactcgagccgatggtggagtccgattgccccgtcttgccgcccatgagggcttgcgacagggaggtctcgaagacgttttcgccgagctcgccgctccggtcggtctccagttgcacgaaggtgatggcgtcgtcggtttggacggcggcccgggacttttctcgcgatttttgatcggtcgcctcttcggtttccttggccagcagcatgtcgttgagggcgttgcggcacagggccgagaacacttgaacgacgggctccgtgcgatcggatagcacgcgcagacagaagagaatgtggtcgttgtcgtcgttagttatctgttttaccggcaaacctgatttgcctaaatgcaaaatgccagccataatcagcataacttcagcatcgaatttattcctatcggaagcggaaacgttttcaccatatctcaacgccaatttggtcaaagtagaggccaaagaagctgcaatgaaaaaatctccatccatgagatattgcctcaatggaggtctcttctcttttgtagatttgctggccacgttgaaagcagattgagtggcgtaagttccatccgaagtaaccaaagtggtggccccggctggtgcatgagctggcgcactatcatctgtactacccgatataatcttttgctcagactccaacagagggcattcgcccaatgtttgaacaatctctttgattacagcttcgatgtcagcagtagatgtagcatattcacctaatatccaaagagcagctcgatgaactttcacagatttgatgtctttgaaggtctccaataatttctcgataatgagcggctccaaattatcgaatttctgtatggcttccctcaaaaatagcaacacatcggtggccgccaattcattgctatcagacaggaattccatcagaacaggaatgacggtagcagctatatcagggaatttgatgcaacaagaatgcaacgttctgaccaacagttgcctatatttcccagtatcctcgtgttcgctatccacagtcttcgacacctccttcttcagcacaaacaccatttcttcgacgttacgtgaagagaccaattcgagcgctaaattaagcgttttctttcgcacttccaaatcaggagccgacaacactctcaatatatccatcaccaagtcctgcaggactctctcgtggctgggatgctccttcaaggcgatcaatctatccaaaacgatcaatttgacgttgttgtcgctttctttaatgatcaattcaatgtaacaactggcggcggctttaatggccgtaggggcgctggacaaagtgatcagagtaccggccgcctcgtatctcacagcaggactgctcgagtttaatagattgtatatgcagcgaatgaacctggatctctcagttgggttagagtggcacactttgtatatcaattcaacgatcaccaactgcagaatatccccgaatgatgccacttgatctaagcaattggataggtaagttagtgctcgatcttgatcggcatgcaagagcatgaggaaagcgtttcttttgcaagacatgtcttgttcgccatctaggtaagtggaaatcaactcaggggcgtccggaatgagaaactcgaaattcttgtatatcgtaaaaatggccagaacggcattccttcggacgtagctgtgcctgtgctccaggcaaattcgaatgctgggcatcaagggctccaatagctcgggctccttcagcttgcataggaatctcaatgtggatcctcgcaggaattcgttggggtgttgcaggtcctttctgtaggcgtcgcaaactaggatcatttcctgcagtaatttgccatcaggggtggttttcggcacgatttcccaaaaaatgagcaaaagcttcttggccaggtgatcttgaagaggcagaacgtttcgtatgattgtcatcaggaatccattgggcaacctctcgcctgccagtatcatgtgaatgattctttccaaagcccttatcttcactttcacttcgcccttttcgagatccattttcaattgcatttcattgtaaggctccgaatcggtcggtaaattaattaaagtgtaacagggctgttcgaccgcggtcatgtttatttctgtttaattaacgcaacaatgccgtaaaatatcgaattgttattagaaaactaaaataaaagtttgtattattcgcgatacgtgtcaagtaaacgtttt

SEQ ID NO: 17 - DNA, 2915 bp, Phyllotreta atra
  misc_feature: COP I betaPrime
ttttttttttaattaatatataaagactgttttatttcttaaaataggaatgaacaatttacataataatataatactaaaaaactgcattaaaattatattcaatcacttaacaagtcgtcatctatattgatatccgttgtatctatattttcatcaatgttcactccatcaagatccaaatccaaatcgtcctcatcagcttcttcattatcaacagagggtttgttcgtttgttcaaccggtgtttcgccgagcaaattatcgaaataacttgcacctgaatttttgactttcgcttgaacctccgctatcatatttctgtcgtgattcggtgtaacggtgacagccgaagcggcaggaatgaaacccggttcgttttgttccaaatatttctgcgccgctatggcctcttgcagccctggaaacagattttcgtaatccttgggatcggccaaactttggccggctttctgattgacagtcgacaattgggccctccaaaggtccaccacctccgaaattttatcgggaagataagatctcgcgaaaaacgccgcttcgggaagcctaccggtgcttatcaaaatgtccagacatttgttcaagtcaccgactaataagtgggacaagaatgccaagttatgcttgccctcggcttccgtggcttcgcctaatgtcctcactacctcgtcatctccagaactggtagctaagagcaacaatccaccgtaatcttgggctttctgcatgcactctttggccaacacgagattattcgtggaggccgccaaatcggccagttggctccatttctgcgggttgttagcctcctgggccaacattttggccgtattcaaatcctccaaagccacggccaattcgaacctgtgctcggggtcggtactaacagccaaagcttgctgcttgaaaccctgcttttccaagaaatgagccaccctggttctatgttctttgggtatggaaggcaacactcggtcggccgtcgagaaatctcttctcataacggccgtttgatactccaacaccgaaagtagcaactggtagctaacgactcgcaattctttgtcgactaagtacagtctatcgtctttcgggacgtagccgagcacgtacaaaggcccgtctaggtgcgctatggtcaccaattcgccgccgacgaagtaattgatgcgattcacggcgttggtgtagatgaaacaatcgcccacccaaagccccgttcgaacggtctcgttgacttcgcctagaagattgaaggcggactccacgccgtcgtcggccacttggttgttttctttcgccttgtggacctcctccacgtcgtaggagagtataaaataactatcttcggtggctaaacacaccaatttgccgctgtccgaccagtagatcgaacggggctgtatttcgattcttctgaccaaatccaacgtttcccagtcgtagaaagccaatcccgagacggattttacccccaaaagataaccgccgtatataccttcggctccgaagtcggatttgaaattctttttttctttgaaatttttgaatattcttatagtggaaccggattctctgatggcgtattcgctggaatcctgcgcccaaacgaattcttgcgcgcttccgaaagctttatttctgagcgccatggcggtgtaaataatgtattccccgtctccacaaacgaccacaaatctaccattcggattgtgctgaatagtttgcgggtagatatcacaagcgcccatatctttgatagaaaccggcaagcgttcaccgtctcttatttcagcaccttcgggcaacgctttaagattagcttgctgtagttccgaatgtctggcccagatgattttaccgccgctggcgtccatactcacagcgggttcttctctaccgactttaaccagaatgctaccctcgtcgtaacccagcgccacgttattggaacctttcagacaaaaaatggtccatactctttcgaaaccgtagttcaaactgctctctaatcggtgcgtgttggcgtgccacactcgaaccgtgccgtcttcgctgccggtgagagcgatcggtaattccggatggaaacacacggccgtgacgttctgtccgtgcccctctaacgtttgtacgcacgttttgttctggtaatcccagattttaaccagcctgtcgtcggcgcccgatattaggtagggtttatcgccaccgtgatagtaatcgacgcaattaacgcccttttcgtgaccctccaacgtgaaattagcagtagaggcgcctaactgccaaacttttattgttcggtccaaagaagcgctggcgaacgtattgttgtctttggggttgatggaaatttgcatgatgtaatgcacgtgcccttcgaacacttgttggcacgcccacgctttttcccagttccacagctttatcagcatatcatcgctactggtcagtatgtaaggttgtgtgggatgaacaacaatggatcgcacgtaatcagagtgagcttcgaaagcgtgcacgcgatctagagtgttgtaattgaaaactctgatttgcatgtcatcggagccactaacgatccagtttttcctcggtacgaatttggccgctctgaccggtagatcgcacacttcgaatgttttgacgagctgctggttttcgtggttccacacgtttatgttgccgctgtatagggaacagagcatccaaggctccgtgggatgtaggtccacgcattttacccggtcagaacgggctgttagctttcttttgatgtctaaccgaagtggcatttttaagcggttttatttaagaattttatttattttcttcaattgacacgaattataaacacatcacacatcaccattctacaaatgtcatcg

SEQ ID NO: 18 - DNA, 1596 bp, Phyllotreta atra
  misc_feature: Act5C
cttgcgttagcctactgcgagtacagcttgtttgttagaaaaattcggctgtgcctttttttgttcgattatccaaccacctactagatttttcaaatactaattcaaaatgtgtgaagaagaagtcgccgctttagtcgtagacaatggctccggtatgtgcaaggccggtttcgccggagacgacgctccgcgcgccgtctttccctccatcgtcggtcgcccaagacatcaaggagtcatggtcggtatgggtcaaaaagattcctacgtaggtgacgaagcccaaagcaaaagaggtatcctcactttgaaataccccatcgaacacggtatcatcaccaactgggatgatatggaaaagatctggcaccacaccttctacaacgaactccgtgtggctccggaagaacaccccgttcttttgaccgaagctcctcttaaccctaaagccaacagggaaaagatgactcaaatcatgtttgaaaccttcaacacccccgctatgtacgtcgccatccaagccgtactttccttgtacgcttccggtcgtaccaccggtatcgttttggactccggtgacggtgtcacccacaccgtacccatctacgaaggttacgctttgcctcacgccatcctccgtttggacttggccggtcgcgatttgaccgactacctcatgaaaatcctcaccgaaagaggttactcattcaccaccaccgctgaaagagaaatcgtccgtgacatcaaggaaaaactctgctatgtcgcattggacttcgaacaggaaatggccaccgccgccgcttccacctcattggaaaagagctacgaattacccgacggtcaagtcatcaccatcggtaacgagagattccgttgtcctgaggctctattccaaccttccttcttgggtatggaatcctgcggtatccacgaaaccgtctacaactccatcatgaagtgtgacgtcgatatccgtaaggacttgtacgccaacaccgtcttgtccggtggtaccaccatgtaccctggtattgctgaccgtatgcaaaaggaaatcaccgccttggcccccagcacgatcaaaatcaagatcatcgctcccccagaaaggaaatactccgtatggatcggtggatccatcttggcttctctttccactttccaacagatgtggatctccaaacaggaatacgacgaatccggccctggaatcgttcaccgcaagtgcttctaagctatttactacttttacctatattatatatactactatatcatgttgtttgtactgtattttacatcaattatgcgaccgtggttgttttactgccagacagacatttcaagatcattttaacaccttatttgttatatataaatatattttaatttgtaaccgggcaggttgaaataaagcctatctaagtaaaaaaacctgcctcttttatttctaatttttaagacaaaacgaaacgagaatatgatgttatgttatattatataataactattgtaacatttttttttaataaatttttggcatagtttatacaatatatatatatatatacacacacaataaaattcaaa

SEQ ID NO: 19 - DNA, 3693 bp, Phyllotreta atra
  misc_feature: COPI alpha
cgcgctcattgtaagtcagccgaaatgttgaccaagttcgaaaccaaatcagcaagggtaaaggggctgtctttccatcccaaaaggccatggattttagccagtttacacaacggctgcatccagttgtgggattatcgaatgtgcactcttctggagaagttcgacgagcacgatggacccgtaagaggcatatgtttccacagccaacagcccctattcgtatcaggtggcgatgattacaaaataaaagtatggaactacaaacagaaacgttgcatcttcacactgcttgggcatttggattacattcgcacgactatgttccaccacgaatatccctggatagtatccgcatccgatgatcaaaccatccggatatggaactggcaatccagaacgtgcatttgcgttttaaccggccacaatcactatgtcatgtgcgctactttccatcctagcgaggatctactgttatccgcttcattggattctactgttagagtttgggatatttctggactacgtaagaagaacgtatcaccgggtccctcggggctcgaagatcacctcaaaaatcctggcgctactgagctattcggccaagccgatgctgtggtgaaacacgttttggaagggcacgatcgaggagtgaattgggcatcttttcatcctttcctacctttaatagcttccggagccgatgacaggcaaataaagctgtggagaatgaacgattcgaaagcttgggaagtagatacttgtagaggacattacaacaacgtgtcttgcgttttgtttcatcctagacaggagctgattctgtctaacggtgaagatagaagtataagggtttgggatatggctaaaaggacttgcttgcatacttttagaagggaacacgaacgattttgggtgatgacgagccacccgaatcttaatttattcgctgctggccacgatggcggcatggtgatattcaaattagaacgcgaacgaccagcttacacggtacacgggaacctactgtattacgtcaaagagaagtatttaagaaaactcgattttaccacttcgaaggacgtccccgttattcaaatcagaggcggcggtaaaataccagtatacaagatgtcctttaatcctgccgaaaacgctgtactactatctactcgcacttccaatctggataacagcacatacgatttgtacatgattcccaaggatcaagaaagggaggatcacgtgcctgaagccgaaagcaagagatcatcgggtcttaccgctttgtgggtggccagaaatcgatttgctgtactggacaggacgcaccagttgatcattaaaaatctgaaaaacgaggtaactaaaaaagttcaaacgcccacttgcgatgaagtcttttacgccggaactggcatgcttttattgagagattccgaacacgttacgttgtttgatgtccaacaaaagaggacattggctcaagttaaaatcagcaaatgtagatacgtcgtgtggtcttctgatatgtcgcatctagctcttctatctaagcataacgtgacgatttgtaatagaaaattggatgttctgtgttcgttacacgagaataccagagttaagtcgggcgcttgggatgatagcggcgttttcatttacactactagtaatcatattaaatacacgttgaaaaatggtgatcacggaattattagaaccctggatcttcccatttacataactagagtcagaggtagtcaggtgttctgtttggacagggaatgtaagcctcgcctgttggtaatcgatcccactgaatacaaattcaaactcgcattgatcaatcacaagtacgaagaggttttgtacatggtcaggaattctcgattggtaggccaaagtattatatcctacttgcaacaaaaaggatatccggaagtagctttgcattttgtaaaagatgacaaaactaggtttgctctggctttggaatgcggcaacattgaaatcgctttagaagccgctaaagctctaaacgataaaaattgttgggatcaattagcacaagccgcattgtggcaaggcaatcatcaaatcgtagaaatgtgctaccaacgtacgaaaagcttcgagaaactatcgttcctctacctaatcaccggcaatttggagaagttgagaaaaatgatgaaaatcgctgaaattagaaaggccagatcgtcccaataccacgccgctttgctgttaggggatctcgaagaacgtgtaaaactactcaaagcttccaatcaattatctctagcgtatttaaccgccgccacgcacggtatgcgagaggaggcagagcaactcaaagaacaaatcggcgatgataaaaaactacccgatgtcgatcctaacgcgaagttcttgaaacccccaccgccgatccaacaagccgaatccaactggccattactcacagtcagcaggagtttcttcgaaaataccgctgccgtggccaccgcatcggccaacatgaaatccctgatggccgaaccgatttccgacgtcggaatggaggacgcccaaggatggggcgacgacgacgagctggaattagaccccgaagacaaaaaagccgaggtcgtcgcggccggcggcgacggcgaaggcggctgggacgtcgaagacgaaggtctggaaattcccgatttaggacccaccgccgcggcggaaggcgaaggaaatttcgtgcatttacccacgcaaggcccctcgccgcctctaacgtggacgaaaaactcgcaattggtggccgatcacgtggcggccggttcgttcgaatccgccgctcgattgcttcacgatcaactcggaatcgtcgatttcaaaccgttcgaaagcttgttcatcaatttgtacagtacttcgaagacggtgtcgtcttggcaacaaaacgtaccgccttcgtttagttacccgttgagaaactggaaggaagccaatattaaaaaccagttacccgcttctggggtgaaattgaacgatttggtcgctaaattgcagatttgctatcaactgaccactggtggtaaattcactgaagccatcgagaaattacaaactctgctgttgtccgttacattgcttgtggtggacaacaaacaagaaatttccgaggctcagcaattactgagaatagccagcgaatatatttgcggtttgcaaatggaaaccttgaggaaaaccttaccgaaaacttcagccgaagagcagaaacgtcagtgcgagatggctgcctatttcacgcattgtaaactacagccgatacatcaaatcctcacgcttaggacggcgctcaacatgtttttcaagctcaagaactacaaaacagccgcttctttcgccaagaggctgttggaacttggtcctaggcctgaagtagcccagcaagctagaaaaatattacaggcttgcgattctaatcttacagatgatttgcaattgcagtatgacgagcacaatcctttcaacttgtgtgggcactcttatacacccatttacaggggaaaggccgaagagaaatgtccattatgcggtacttcatatttacctaaatacaaaggggtattgtgtaatatttgcaaagtggcggaagttggaaaggatacgattggattgaggattagcacgcatcagtttaggtaa

SEQ ID NO: 20 - DNA, 3693 bp, Phyllotreta atra; identical to SEQ ID NO: 19
  misc_feature: COPI alpha

SEQ ID NO: 21 - DNA, 3693 bp, Phyllotreta atra; identical to SEQ ID NO: 19
  misc_feature: COPI alpha

SEQ ID NO: 22 - DNA, 3693 bp, Phyllotreta atra; identical to SEQ ID NO: 19
  misc_feature: COPI alpha

SEQ ID NO: 23 - DNA, 3693 bp, Phyllotreta atra; identical to SEQ ID NO: 19
  misc_feature: COPI alpha

SEQ ID NO: 24 - DNA, 3693 bp, Phyllotreta atra; identical to SEQ ID NO: 19
  misc_feature: COPI alpha

SEQ ID NO: 25 - DNA, 3693 bp, Phyllotreta atra; identical to SEQ ID NO: 19
  misc_feature: COPI alpha

SEQ ID NO: 26 - DNA, 3693 bp, Phyllotreta atra; identical to SEQ ID NO: 19
  misc_feature: COPI alpha

SEQ ID NO: 27 - DNA, 3693 bp, Phyllotreta atra; identical to SEQ ID NO: 19
  misc_feature: COPI alpha

SEQ ID NO: 28 - DNA, 3693 bp, Phyllotreta atra; identical to SEQ ID NO: 19
  misc_feature: COPI alpha

SEQ ID NO: 29 - DNA, 3693 bp, Phyllotreta atra; identical to SEQ ID NO: 19
  misc_feature: COPI alpha

SEQ ID NO: 30 - DNA, 3036 bp, Phyllotreta atra
  misc_feature: COPI delta
atatcttacacgatgagttccaagatagatccggctaaactgaaggtagtagatttacggaatgaactttcggctcgagggctcgacgtgaaaggcaccaaacctatactcgttaaacgtttaaaagaagctttagagaacgaattagatgaagaaatagctgatacatcaatattagatacctcgacagaggaagtcgaagaagacctaacgccaaaaaataccttgcttacggaagcaaaggatgaagcgagggtcaaggagagcgccccgtctccagaaaagcaacaacccgacgagggtaaatccgaaacaaccaacgaacctgtggcaacactagaacctacaccggtgcctgaaatcgaatcgacgcctgcgccagtcgtacctgaagctaagcctacgcctgtacctgaggaatccaaacctttggtgaaatcgcctgaagatggcccagtcgaatcatctgaaacgcctacaatagaagacgatgacgctgaacaacaagaagagtcgaatacaactgagaatcttcccacttctgcggaagctaattccgaaaccattgacgaagctaaacccgaacaagaaaatggagaacaggaagagaaaatggacgctcaggacgatgcctcgaagacagcggaggaaaaggatgccgatgaccaacaaaaaggggaaaagcgcaagagaagcagcgattcgcctgatcgatcgcacaagcgaccgaggactcccatcaaagaagatgagcctgacataaacgccgaggctgtacagctcagctggtacgattcagatctatacttgcaagttgacaaaagttcatttttatccgccaagccaatgaacgatggagcatttggatatgtatgggccggagctagagctacacacggtatttccacaggaaaggtttattacgaaatgaaagtaactgagaaattaaaatgggacgattggcaacaacaaccagatcatcgagataaccggtacaggtcggatagacgaagcagaagagattattacgacagagacgataagagaaacgctgataacgtcaaaaacgattcagagaaaccgaaagaagaccccaaagagactgataacgtgagtgagaataaagacgaagaaattcccagcgagaaggaagagaaggatcaaaccgaggctgaggcagtggaaccaatggagactactgagagtgaagtaaacgagaagaaagatgaggacaaacaagacgagaaagacgatcagaatgaaacagatgagaagaatgagcaagacggtaaaaatgaacaggacgataagatcgaaaaagaggacaaaaaggaggaaccggctgaagaattcgttcctatacccactcactttattagattgggttggtcagccgcttggacttcactacaattgggtgaagatgataaatcatacggctacgattcttcaggaaaaatcgttaaaaataaggagttctctgattacggaataacattcgacgttggagacgtaatcggtgcatttttggacatcaacgactcttctataacgctacagttcaccgtgaatggacaaattcaaccgactattgaaatacccagggacgatttacccgatgatttgacgctaatcccgcacgttctatcccgaaactacgctttggaattgaatttcggcgaacaggaggaaccctggtttgtcgcaccctcggaactttccgactatcaatttctgagcaaagtggaaaacaaagtagccggcccagcgagacctgaaagtcgatcggactgcgaagtacttatgatgtgcggtttacctgcttcgggaaaaagcgaatgggtgaaaaatcacgttgctactaccgatgttgataaacattatacggtattgggtgtttcgaatttatttgaaaggatgacggtatttggagaaccaatgaagtcgaagttcaagggtaaatggagcactctggtggacaggatctcgaaaattttgaatagattagtattcatggcggctcaaagaaggaggaactatattatcgatcagacaaacgtgttcccatcagcccagcgccgtaaaatgcggccgtttgagggcttcaagagaaaggcgatcgtacttgtaaatgaagacgaagaacaggctagacgtcaggctttgcaagagaccctggagggtaaagaggtccgcgatagtactttacttgacatgaaagctaccatggctatacccgaaactggagattggatcgaagaggtcgtttacgtcggcgtagacgaggaaaaggccaagaaaatcatcaaggattacaacacagagggtcaatcggccggctacgggcacgagaaaagatacaagagagattggtggaaccaaaacaaaagaaataactaccgctcgggaaggaactaccaacggccaagaggcggcggctacaaccgccaatacggcccgtccccgtgggttcaatcgagacaaggcggcggcggcggtggaggatggaaagatcaaagaacacgcgaatggagaggcaacgattacaacagaagagacagggattattattcgcaatccggctatggtggcggcggtcgttatcaatcgagcaacagatcgcagggcggcggcggtcagcgttggggcggtaacggcggcggcggtggttcgtggggaggcggttggaatcagcagagcttcggcaggcagaattggaataatcaaggaggcagcggtggcggcggcggtcaaggcaactggagcggcggtaaatacggttcgtccggttcgggatacaacagctggagttattacggtcaacagcaacagcattggagcggacaggggcagcagcagcaacaacaaagtcattctggttatgcgatgaatacccagagtcagggtcaaacgcagggccagtattcccaagcttatagtacccaggaagcgtgggcacaatacgccaagcagtatgctcagcatcagcaattggcacaaaatcaagcggcggctgatacgacccaaaacaaataa

SEQ ID NO: 31 - DNA, 3036 bp, Phyllotreta atra; identical to SEQ ID NO: 30
  misc_feature: COPI delta

SEQ ID NO: 32 - DNA, 3036 bp, Phyllotreta atra; identical to SEQ ID NO: 30
  misc_feature: COPI delta

SEQ ID NO: 33 - DNA, 3036 bp, Phyllotreta atra; identical to SEQ ID NO: 30
  misc_feature: COPI delta

SEQ ID NO: 34 - DNA, 3036 bp, Phyllotreta atra; identical to SEQ ID NO: 30
  misc_feature: COPI delta

SEQ ID NO: 35 - DNA, 3036 bp, Phyllotreta atra; identical to SEQ ID NO: 30
  misc_feature: COPI delta

SEQ ID NO: 36 - DNA, 3036 bp, Phyllotreta atra; identical to SEQ ID NO: 30
  misc_feature: COPI delta

SEQ ID NO: 37 - DNA, 3036 bp, Phyllotreta atra; identical to SEQ ID NO: 30
  misc_feature: COPI delta

SEQ ID NO: 38 - DNA, 3036 bp, Phyllotreta atra; identical to SEQ ID NO: 30
  misc_feature: COPI delta

SEQ ID NO: 39 - DNA, 3036 bp, Phyllotreta atra; identical to SEQ ID NO: 30
  misc_feature: COPI delta

SEQ ID NO: 40 - DNA, 3036 bp, Phyllotreta atra; identical to SEQ ID NO: 30
  misc_feature: COPI delta

SEQ ID NO: 41 - DNA, 933 bp, Phyllotreta atra
  misc_feature: COPI epsilon
aaaaaaatcaaaacaaaaatggcacgtcagcagcaagacgtagacgagcttttcgaaattaaaaactacttttacataggaaactaccaacaatgcataaacgaagggcaaaaactaagaaagccctcaaccccagaagtcgccatccagcgagacgtattcacctacagatcgtacatggcccagaacaaattcttagtcgtactagacgaaatccacggggcctcctctccagaaatccaaccactaaaactcctggctgagtacctatccggtaaagtcaagaaggatgccgtagtgtctcaaatcgaccagcaagtaatggcgaacgccagcaacgacaccctagtgttgactgcagccactgtttacgtcaacgaaggcaacttggaagccgcttacaaagtgcttcacgcttcggaaaatctggaagcttacgccttcatcatcgatatattattgaagttagatcgggtagatttggctaagaagaagctcaaggaaatgcaggataaagatgatgatgctacgttaacacagctagcgcaagcttgggttaatgttgcaattggaggtgataaattgcaagatgcttactacatttaccaagaaatggttgataaatatggctcgacgcctcttctgttaaacgggcaagcagtggcctttatagggcaggctaaatacgaggaagctgaagctgctttgcaggaagctatagataaagatgctaattatcctgatacattggttaatttaattactcttcaaaggcatatggggaaaggtcctgagattgctaatagatatttatcgcaattgaaagacgccaatcccgaccatccttacataaaggacttgaagcataaagagagcgagttccagagaatatgtcaacagtatacacctacagtaattaccattccatcgtaa

SEQ ID NO: 42 - DNA, 1008 bp, Phyllotreta atra
  misc_feature: COPI epsilon
aaaaaaatcaaaacaaaaatggcacgtcagcagcaagacgtagacgagcttttcgaaattaaaaactacttttacataggaaactaccaacaatgcataaacgaagggcaaaaactaagaaagccctcaaccccagaagtcgccatccagcgagacgtattcacctacagatcgtacatggcccagaacaaattcttagtcgtactagacgaaatccacggggcctcctctccagaaatccaaccactaaaactcctggctgagtacctatccggtaaagtcaagaaggatgccgtagtgtctcaaatcgaccagcaagtaatggcgaacgccagcaacgacaccctagtgttgactgcagccactgtttacgtcaacgaaggcaacttggaagccgcttacaaagtgcttcacgcttcggaaaatctggaagcttacgccttcatcatcgatatattattgaagttagatcgggtagatttggctaagaagaagctcaaggaaatgcaggataaagatgatgatgctacgttaacacagctagcgcaagcttgggttaatgttgcaattggaggtgataaattgcaagatgcttactacatttaccaagaaatggttgataaatatggctcgacgcctcttctgttaaacgggcaagcagtggcctttatagggcaggctaaatacgaggaagctgaagctgctttgcaggaagctatagataaagatgctaattatcctgatacattggttaatttaattactcttcaaaggcatatggggaaaggtcctgagattgctaatagatatttatcgcaattgaaagacgccaatcccgaccatccttacataaaggacttgaagcataaagagagcgagttccagagaatatgtcaacagtatacacctacagtaattaccattccatcgtaaatattatgattgtataaagaaaacattgtgtaaacaaataaaaatacattttaatctactattaaaaaaaaaaaa

SEQ ID NO: 43 - DNA, 1008 bp, Phyllotreta atra; identical to SEQ ID NO: 42
  misc_feature: COPI epsilon

SEQ ID NO: 44 - DNA, 1008 bp, Phyllotreta atra; identical to SEQ ID NO: 42
  misc_feature: COPI epsilon

SEQ ID NO: 45 - DNA, 1008 bp, Phyllotreta atra; identical to SEQ ID NO: 42
  misc_feature: COPI epsilon

SEQ ID NO: 46 - DNA, 1008 bp, Phyllotreta atra; identical to SEQ ID NO: 42
  misc_feature: COPI epsilon

SEQ ID NO: 47 - DNA, 1008 bp, Phyllotreta atra; identical to SEQ ID NO: 42
  misc_feature: COPI epsilon

SEQ ID NO: 48 - DNA, 1008 bp, Phyllotreta atra; identical to SEQ ID NO: 42
  misc_feature: COPI epsilon

SEQ ID NO: 49 - DNA, 1008 bp, Phyllotreta atra; identical to SEQ ID NO: 42
  misc_feature: COPI epsilon

SEQ ID NO: 50 - DNA, 1008 bp, Phyllotreta atra; identical to SEQ ID NO: 42
  misc_feature: COPI epsilon

SEQ ID NO: 51 - DNA, 1008 bp, Phyllotreta atra; identical to SEQ ID NO: 42
  misc_feature: COPI epsilon

SEQ ID NO: 52 - DNA, 2016 bp, Phyllotreta atra
  misc_feature: COPI gamma
gatttcatcgagtcctgtctgagacacaaatccgaaatggtagtttacgaagctgcccacgccattgtcaatctaaaacgcactactagcaaagaattagcgcctgccgtaagcgttttacaattattctgcggttcaccgaaggctactttaagatttgccgctgtcagaacattgaatcaagtggcgatttcacatcctgctgctgttacggcttgtaatttggatttggagaatctgattaccgattctaacagatccattgccactttagctattactactttgttgaaaacaggtgctgaatcttcggtcgatcgtctaatgaagcaaatagcgagtttcgtgtctgaaattagcgatgaattcaaagttgtggtagttcaagcgatcagagcactggctcttaaattccctcgtaaacacaacacgctcatgaactttttatcggctatgctaagagatgaaggcggtttggagtacaaagcttccattgcagacaccataattaccataatcgaagataatcctgaagctaaagagtcaggtttggctcatctgtgcgagtttatcgaagattgcgaacacgtttcattagctgttagaatattgcatctgctaggcagggaaggaccgaaaaccaaacaaccttctaggtacatccgcttcatctacaaccgcgtcatcttagagtgcccttccataagagcagccgctgtttccgccatggctcaattcggagcttcgtgtcccgatttgttagaaaacattcaagtattactagccagatgccaaatggactcggacgatgaagttagagacagagccacctactacagcagcatactcaataaaaacgataagaacttgtacaacaattatatcctggatactttacaggtatccataccgtcgttagaacgctcgttgaaagagtacacgcagagccctacgaatcaaccgttcgacataaaatcagtcccattgcaagtgggcccgtctccggacgagcgcgagaagaaacacaagtccgaaggtatgttaacatcgcaaggacccttgcggccgccgcccgtctcccgcgaggagaacttcgcggagaaactgtccgccataccgggcatccagcagctgggcccgatcttcaagagctccgaggtggtggagctgaccgaatccgagacggagtacttcgtgcgctgcatcaagcactgcttcgcccgccacgtggtcctgcagttcgactgcctgaacacgctggccgatcaattgctggaggacgtgcgcgtggagctggagccgagcgaggggttcgagttgctgtcggtggtgccgtgcaagcagctgcactacaacgagaccgatcacacctacgctatattgaagttccccgacgacgatttgccgagttgcgtcggtacgttcggggcggtgttgaagtttatcgttaaagattgcgatcccaccaccggcattcccgatagcgatgaaggttacaatgatgaatacatactcgaagacttggaaataacgttgggcgatcagatacagagagtgagcaaaggcaattggggcgccgcttgggaatcggctgctgagggttccgtggaaaaggaggatacgtattctctcagttcgatgaatacgttggacgaagctgtgaagaatatcgtgcagttccttggattgcaaccggccgaaagaactgataaagtgcccgaaggcaagagcacccacacgcttctactatcaggagtctttagaggaggaatcgatattttggtaagagctaaacttgctttggcggatggtgttacaatgcaattgactgtaagatcacccgatgacagcatagctgagcttattacctcttctgtaggttaagatataaatattttatttactatttaattaaatgtattacaatattccttataattaaatttttcgataattcggaggattaaaagttattctagagtttatttaaatgacgaattgattttcctggcattt

SEQ ID NO: 53 - DNA, 2016 bp, Phyllotreta atra; identical to SEQ ID NO: 52
  misc_feature: COPI gamma

SEQ ID NO: 54 - DNA, 2016 bp, Phyllotreta atra; identical to SEQ ID NO: 52
  misc_feature: COPI gamma

SEQ ID NO: 55 - DNA, 2016 bp, Phyllotreta atra; identical to SEQ ID NO: 52
  misc_feature: COPI gamma

SEQ ID NO: 56 - DNA, 2016 bp, Phyllotreta atra; identical to SEQ ID NO: 52
  misc_feature: COPI gamma

SEQ ID NO: 57 - DNA, 2016 bp, Phyllotreta atra; identical to SEQ ID NO: 52
  misc_feature: COPI gamma

SEQ ID NO: 58 - DNA, 2016 bp, Phyllotreta atra; identical to SEQ ID NO: 52
  misc_feature: COPI gamma

SEQ ID NO: 59 - DNA, 2016 bp, Phyllotreta atra; identical to SEQ ID NO: 52
  misc_feature: COPI gamma

SEQ ID NO: 60 - DNA, 2016 bp, Phyllotreta atra; identical to SEQ ID NO: 52
  misc_feature: COPI gamma

SEQ ID NO: 61 - DNA, 546 bp, Phyllotreta atra
  misc_feature: COPI zeta
aattcactaatggaaggctcgttattggaacccactttgaacgccattaaaggcatagctatcttggataacgatggaaaccgaatattggcaaagtactacgacaaaaacgtatttcccacagcgaaagagcagaagactttcgagaagaatctgttcaacaaaacccacagggcgaacgccgaaattataatgctcgatggccttacgtgcgtgtacaagagtaacgtagatttgtttttctacgtcatgggtagttctcatgaaaatgagttaattctaatgagcgttttaaattgcttatacgattccgtgagccaaattctaaggaagaatatggagaagagggtagttttagattcgttagatatagtcatgttggccatggatgaaatctgcgatggagggattatcatcgatgccgattcgaactcggtggtatcgagggtggctttaagaaacgacgacattccgattggggagcaaacagtcgcccaggtgtttcaatcagccaaagaacagctgaaatggtcattattaaagtaa

SEQ ID NO: 62 - DNA, 546 bp, Phyllotreta atra; identical to SEQ ID NO: 61
  misc_feature: COPI zeta

SEQ ID NO: 63 - DNA, 546 bp, Phyllotreta atra; identical to SEQ ID NO: 61
  misc_feature: COPI zeta

SEQ ID NO: 64 - DNA, 546 bp, Phyllotreta atra; identical to SEQ ID NO: 61
  misc_feature: COPI zeta

SEQ ID NO: 65 - DNA, 546 bp, Phyllotreta atra; identical to SEQ ID NO: 61
  misc_feature: COPI zeta

SEQ ID NO: 66 - DNA, 3987 bp, Phyllotreta atra
  misc_feature: RpL07
atatctaaaatgactctagaggaagaattattaattcacttaaacaacgaggaagaaacgttcacaactaaattgcagtatgtagacaattttttcaagtctaccgaattgcctgtaacatgtaaaattatcctcttaaagtggattttacaacaaaatgaggtcgatttaatatggaaaacactggaaaatttggtgtcttctgcctattttaaaggaatcaatagaaatgaaattgatacgcagagtataaaacaaatcgtagaaggtatcatcgagaaagttacttcacaacctgaagttaaaagggaagaatgttccacagtgactcacctcgtacagcacaaagtattcgaacaatatttcaaattcgatttagaactgtatttcaaattattggacagtattttgatcaagattaacagccaagaataccttttcgaattcctgagcgcaaatttgttttacaaaagtttactgaacaccgaaactttcgttgaaaattttatgagccaaatatttcccactctaaataaatgcgtaaaaaagttcccagacaaaaatgcgtttcttcacctatcacaagtcgttcaaaagtgtttatttcataacaaccagaagaagttcgagcattttgtcaacgaaattttcaaaccagacgatggggagtactttgggttcgatattttactgaagcatcttcaaaaccttatcgaatcgaacaaaaaatcctctgaacattattttaaactgatgtttcacgcgtgtgttgtttcatacggaaacaactctttattgacatacaaatatttcctaattttgatccacattattggatttcggtacgaaataatccctctcaccaacgatttaatttccaacaaccagaaagacagcaaaaaatcgtacaaaatactattagacctactgggcgttttagaagagacgaaattagaaacgaactgtaaaattaacgaaattaacatcaccgaagtgttgaaaacaatcttaaccgaatcgatcattcccaacaaaccgtccaaaacaaattatcaaatcatcgaaaaaatcatccagttagatcctgctataacacaaattgcacaactaactgagcaaattctgaattactccctgctggtagacaattccaaccatattgaccaatacgaagggttgattttaactatattcgagctgttttcgaaactacacagaaccgagaatttaatctctaaaatagttgtaacacttaacaattatttcgataatgtgaacaatggggattgtggagttttggctgttgagaatatttttactaagaagattttggtatcgtttacgaaaaatatacaaactttagccagttggcaggtgataaacgtattcaaaacgttattgaatgctttgatcaagcagctagagaaggaaactagtgaggatgtgtattgcatacatatggagcttctcagcgagttgatttgcacatttttgtccagcataagagtagcagagcacacagtggcttcgaatgtagtagaaaaaactaaaaaatgcctccaggaattgcaagatattttgaaaacgttcggaaaatcgctactaaacaaaacccataattgcagcttaatgaggtcctttttaaaaatagccttccattgggctgaaatggggatcatactgaaatattactcgagccctcaggattctacacagaagaaagctttagaatacaattgtatggctagcaacattacttatttacatccatatttaacacacgaagattggtgttcgatttcagagagaatcaacaacttcggagaagtaccttgcaagcaattattgtacaaattgtacacacagaaagttcgtgcattgtgcatattcgaacaaaaacttaccaacgaagtgttagtggatttatcgaggtatctgacatcagatttggagaataattggaaggatatcctgcaggataaattcttaactaacaatttaatgcatactttagatccggaaagtaggattattttagctgagaaaatcgtgtcgaacatcgatgattttggaaatgtttatcagtatgctcacatatttaacaactcttcgattttgaaagctgtaatttattacacgattacgaaatgcgatagaatattggtgaagaggaaaaggaagtcagatgaaaatttgagcatgtcgaaattaattagcacaaaagtttgcgaatgtttggatgttgttcgattccacgatgaaactattctgaaagattctattagtaaaataagcgaaatatataaatcgaataattcggatggtgaagttaaattcaacgaagagaaaattttggagttggtgaagattttgaaacaatttccggtaatcttctgtgaagcaaatgtgcagaatttcttcattctatattttttttcgctacacaaagaccttagtaattgcttttcaaaaggacaattcgttgaattacgaaaagttttagaggatttaatcgttggtacactacaacagtacaagtacaaattatccaccatattcgccataaaaccgctctgtgtggaaatcctaaacaatttcaacgaatggaaagaactgttcgttctcataatcgaaaatatattcaaatataatgattcaatcgctagttatgattcactcattgagcacattacaaataacttgcgaaatcctgtctacttgcaatgcggaattataattataaatgccgttaacaagttaaaaaaaatgaaggtccccaaagaaatcaaaaaccatacggaaaactacaaatcgtcgatttgcaatggaatttgcgatttagtattaacgagtgaacctaataatcatttagtatgcggatatgcgtacgccttgaaaatattattcgtgcaaaacgaagacgagaagctttcgaagatgctagatgtattgaattcttatgttaatttcgccttggagaagaaggacgatttcgacaaaaccgggtacttattgctgttcaatacagtgttaaacaacaaaactaaaatcaaggaattcgacgatgagctgtacataaaaatttggaatttatgcaaaaacaacgataaagtttttactagaattgaggagtattcgcaattggtgttcctgatggtttgtttgatgtccaacgaacaattcaattgcattattgtagatctagcaattctgtctaatcaggcacttaaagagaataattataaaaattatgtaagcttcctgaaaacgtgggagtccattatcactgctaatatcaaccctgtgaaaaccaatcgtttgcaacgaggagtggaaagtttgctgagcaattcgcttgtacatttagaattatcccaatatgatcaggagttattcgaaaacatcctgcagtttgagatactgctcgtccaaacgaagcactttcatctcacatcgcctacgatggatttgctgatactaagcgtaactactttgctggaaaaggagcctctttcgttcgtttctttttacaatttgctggtttctttgctgtcgaatttgctcaaattcagaaaagctttagtcatggatagattgccgccttatttgcaacaatacagggccttgttgagagtgttgtgtctgaagggggattccaacaaagaacgaaacgagcattttatcagcgatttgtccgattgtgcttaccagttggagaaattaacgaagagtttggtggagcatcagaaggatatggccagaatcgctatgtatttagttgctgatattctggcgcagtatgagagagttacgatttatcccaatatcaaaatgcatctgaacaactgcatttatagtttgataaccatctgtgatcagcacgctgtttcgtgtttaatgagggttttgtccagcgcttccacagaaattttcaaagtaatgtatgagaattataagaaatactacaggttcactggtaaagcttag

SEQ ID NO: 67 - DNA, 3987 bp, Phyllotreta atra; identical to SEQ ID NO: 66
  misc_feature: RpL07

SEQ ID NO: 68 - DNA, 3987 bp, Phyllotreta atra; identical to SEQ ID NO: 66
  misc_feature: RpL07

SEQ ID NO: 69 - DNA, 3987 bp, Phyllotreta atra; identical to SEQ ID NO: 66
  misc_feature: RpL07

SEQ ID NO: 70 - DNA, 3987 bp, Phyllotreta atra; identical to SEQ ID NO: 66
  misc_feature: RpL07

SEQ ID NO: 71 - DNA, 3987 bp, Phyllotreta atra; identical to SEQ ID NO: 66
  misc_feature: RpL07

SEQ ID NO: 72 - DNA, 3987 bp, Phyllotreta atra; identical to SEQ ID NO: 66
  misc_feature: RpL07

SEQ ID NO: 73 - DNA, 3987 bp, Phyllotreta atra; identical to SEQ ID NO: 66
  misc_feature: RpL07

SEQ ID NO: 74 - DNA, 3987 bp, Phyllotreta atra; identical to SEQ ID NO: 66
  misc_feature: RpL07

SEQ ID NO: 75 - DNA, 3987 bp, Phyllotreta atra; identical to SEQ ID NO: 66
  misc_feature: RpL07

SEQ ID NO: 76 - DNA, 3987 bp, Phyllotreta atra; identical to SEQ ID NO: 66
  misc_feature: RpL07

SEQ ID NO: 77 - DNA, 1557 bp, Phyllotreta atra
  misc_feature: Rpn3
caatgtcaacacgccaattgtcatcgttacacagcgaaaaacaatttttcagcaactaattcttgttttccaaatattcgaataaaaatgggcgtagaaaccgacgtcgagatgaaaaacgcagacagcccggcaggcttagaagctggagacagcaagcgtgacatcgacttacaaagcgtcttggaaattcgcgaacatgccaggcagatcgagaaggcagtgagcagcaaagaaaaccgatttatattgagagtgctgcgctgcttgccgaacaccagacgcaaactgaacggaaccgtcctcaggagcctcatcaatcaaatgtaccccgtcgccgagcgggacgtgctgttcggcctcagcgaggagtccgccagtgacgtagacgctacacagtcaagggccagatcagccaccaaaacccctcttcccgaagtggacgcttacattaacttactacttttagtccgactgatcgataccaacaagctggccgaagccgagcgttgctcgaacataatcatgaacaaattcaccagccagaaccgacggactttagaccacatagcagctaaatgctacttctaccattcgagagtggccgaactcaccgacaagctcgactccatcaggggtttcctgcactcccgactgcgcacagccaccctgcgaaacgacttcgaaggccaagccgtgctgattaattgtctgctaagaaattacttgcactactcgctctacgatcaagctgataagttagtgaataaatgcgtctatcccgaaacggctagcaacaacgaatgggccaggtttttgtactatttaggtcgaattaaagctgcacgattggagtacagcgttgcgcataaacacctaattcaagctatgaggaaatcgccccagaatgctgcgatgggcttccgacaaacagtgcaaaagcttaccgttgtagtcgagttgctgttgggggatataccagaaaggcagatcttcaggcaggccagcatgaggcactcgttggccccttacttccagttaacccaggcggttaggatggggaatttgcatagattcggagaagtactggagaactttgggccgcaatttagattggatcatacttttactttaatactacggctgcgtcacaacgttataaaaacagccattagatctatcgggttgtcttactcgagaatatccccgcaagatatagctaagaaactcggcctggattgcgctgaagatgcagaatttatcgttgctaaagctattcgggatggtgtaatcgaggctatcttggatccacaaggggggtatatgagaagcaaggaaagcacagatatttattgcactaaagagccgcaactcgcttttcatcagaggatatcgttttgtttagacctgcataatcagagtgtgaaagctatgagatatcccccgaaggcgtacgggaaagaattggagtctgccgaggagaggcgagaaagggagcaacaagatttggagctagcgaaagaaatggccgaggaagatgatgatggatttccttaa

SEQ ID NO: 78 - DNA, 1600 bp, Phyllotreta atra
  misc_feature: Rpn3
caatgtcaacacgccaattgtcatcgttacacagcgaaaaacaatttttcagcaactaattcttgttttccaaatattcgaataaaaatgggcgtagaaaccgacgtcgagatgaaaaacgcagacagcccggcaggcttagaagctggagacagcaagcgtgacatcgacttacaaagcgtcttggaaattcgcgaacatgccaggcagatcgagaaggcagtgagcagcaaagaaaaccgatttatattgagagtgctgcgctgcttgccgaacaccagacgcaaactgaacggaaccgtcctcaggagcctcatcaatcaaatgtaccccgtcgccgagcgggacgtgctgttcggcctcagcgaggagtccgccagtgacgtagacgctacacagtcaagggccagatcagccaccaaaacccctcttcccgaagtggacgcttacattaacttactacttttagtccgactgatcgataccaacaagctggccgaagccgagcgttgctcgaacataatcatgaacaaattcaccagccagaaccgacggactttagaccacatagcagctaaatgctacttctaccattcgagagtggccgaactcaccgacaagctcgactccatcaggggtttcctgcactcccgactgcgcacagccaccctgcgaaacgacttcgaaggccaagccgtgctgattaattgtctgctaagaaattacttgcactactcgctctacgatcaagctgataagttagtgaataaatgcgtctatcccgaaacggctagcaacaacgaatgggccaggtttttgtactatttaggtcgaattaaagctgcacgattggagtacagcgttgcgcataaacacctaattcaagctatgaggaaatcgccccagaatgctgcgatgggcttccgacaaacagtgcaaaagcttaccgttgtagtcgagttgctgttgggggatataccagaaaggcagatcttcaggcaggccagcatgaggcactcgttggccccttacttccagttaacccaggcggttaggatggggaatttgcatagattcggagaagtactggagaactttgggccgcaatttagattggatcatacttttactttaatactacggctgcgtcacaacgttataaaaacagccattagatctatcgggttgtcttactcgagaatatccccgcaagatatagctaagaaactcggcctggattgcgctgaagatgcagaatttatcgttgctaaagctattcgggatggtgtaatcgaggctatcttggatccacaaggggggtatatgagaagcaaggaaagcacagatatttattgcactaaagagccgcaactcgcttttcatcagaggatatcgttttgtttagacctgcataatcagagtgtgaaagctatgagatatcccccgaaggcgtacgggaaagaattggagtctgccgaggagaggcgagaaagggagcaacaagatttggagctagcgaaagaaatggccgaggaagatgatgatggatttccttaaattgtataggaattatgagttttcgaagataggattcaatttt

SEQ ID NO: 79 - DNA, 1600 bp, Phyllotreta atra; identical to SEQ ID NO: 78
  misc_feature: Rpn3

SEQ ID NO: 80 - DNA, 1600 bp, Phyllotreta atra; identical to SEQ ID NO: 78
  misc_feature: Rpn3

SEQ ID NO: 81 - DNA, 1600 bp, Phyllotreta atra; identical to SEQ ID NO: 78
  misc_feature: Rpn3

SEQ ID NO: 82 - DNA, 1600 bp, Phyllotreta atra; identical to SEQ ID NO: 78
  misc_feature: Rpn3

SEQ ID NO: 83 - DNA, 1600 bp, Phyllotreta atra; identical to SEQ ID NO: 78
  misc_feature: Rpn3

SEQ ID NO: 84 - DNA, 1600 bp, Phyllotreta atra; identical to SEQ ID NO: 78
  misc_feature: Rpn3

SEQ ID NO: 85 - DNA, 1600 bp, Phyllotreta atra; identical to SEQ ID NO: 78
  misc_feature: Rpn3

SEQ ID NO: 86 - DNA, 1600 bp, Phyllotreta atra; identical to SEQ ID NO: 78
  misc_feature: Rpn3

SEQ ID NO: 87 - DNA, 1600 bp, Phyllotreta atra; identical to SEQ ID NO: 78
  misc_feature: Rpn3

SEQ ID NO: 88 - DNA, 987 bp, Phyllotreta atra
  misc_feature: Rpn8
ttaattaaaatgccgagtacagaggttacaacgactaaggtgatagtgcacccgctggtgcttctcagcgtagtggaccatttcaatcggatgggcaaaatcggcaatcaaaagcgtgttgtcggtgttctactcggttgctggagggccaaaggagtcttagatgtgtccaacagtttcgcagtccctttcgatgaggacgacaaagacaaatctgtatggttcttggaccacgactacctggaaaacatgtacggcatgtttaagaaagtcaacgctagagaacgcgtcgttggttggtaccacaccggtcctaaattacaccaaaacgacatcgctatcaacgaattagttcgaagatactgccccaattcagtcttggtgattatagatgcgaaacctaaagatctggggcttcctactgaagcataccaagcggtagaagaagtccacgatgatggctcacccacatctaaaacgtttgaacacgtcccgagcgaaataggcgcagaagaagctgaagaagtcggagtagaacatttactaagagatatcaaagacactacagtgggaactttatctcagaggattactaatcagttattaggccttaaagggttgcatttgcaattgaaagatataagagactatttgatgcaagtgtgcgataacaagctgcccatcaaccatcagatcatctatcaattgcaggatattttcaatttgttgcccgatataaatcaggatgcgttcaacaattcgttttatgttaaaaataacgatcaaatgcttgtagtttatttaggagctctcgttcgatctatcgttgcattgcacaacctaatcaacaacaaactcaccaacagagacgcagaagaaggcaaaaaggaggagaaaaaggacaacaaggataaagatagcaaagacaaggataaggaaaaaacggacaaagagaaggaagcgaagaaggacgagaagaaaaaataa

SEQ ID NO: 89 - DNA, 987 bp, Phyllotreta atra; identical to SEQ ID NO: 88
  misc_feature: Rpn8

SEQ ID NO: 90 - DNA, 987 bp, Phyllotreta atra; identical to SEQ ID NO: 88
  misc_feature: Rpn8

SEQ ID NO: 91 - DNA, 987 bp, Phyllotreta atra; identical to SEQ ID NO: 88
  misc_feature: Rpn8

SEQ ID NO: 92 - DNA, 987 bp, Phyllotreta atra; identical to SEQ ID NO: 88
  misc_feature: Rpn8

SEQ ID NO: 93 - DNA, 987 bp, Phyllotreta atra; identical to SEQ ID NO: 88
  misc_feature: Rpn8

SEQ ID NO: 94 - DNA, 987 bp, Phyllotreta atra; identical to SEQ ID NO: 88
  misc_feature: Rpn8

SEQ ID NO: 95 - DNA, 987 bp, Phyllotreta atra; identical to SEQ ID NO: 88
  misc_feature: Rpn8

SEQ ID NO: 96 - DNA, 987 bp, Phyllotreta atra; identical to SEQ ID NO: 88
  misc_feature: Rpn8

SEQ ID NO: 97 - DNA, 987 bp, Phyllotreta atra; identical to SEQ ID NO: 88
  misc_feature: Rpn8

SEQ ID NO: 98 - DNA, 1188 bp, Phyllotreta atra
  misc_feature: Rpn9
gaaatttttgtcttgtcatcacagaaaatggctgcagctgcggtgcaaccgtctaatgttagtgattatcttgctaaacaacaaaaagaaagtccgaaggaattgggctctgagtgggcagaacttgaggagctccataataaaaaattatggcatcaactaaccctcaaattactagtgtttataaagaaaccagaattacagaaagcggacaacctaatccagctgtatcacaattttattcaaacgttcgaaaataaaatcaatcctttgtctttggtcgaaatagcggccattgtcgtcgaacagtacaaggaaccgaaagacgcgatcgctttcctagaaaagactgaacccaaagtgaaaatcaacccggacgcccaaaacctgtgcaaagtcctcgaaggacagatctaccttgataagttaaacgatttagacaccaccaaaaagatcatcgaggaggtcgaagcgacctttgataatgcggacggggttaccccagtacacgggagattttatttactcgcctcgcaatattacagaattcaaggagaccatgcgcaatattatcgcaccgctttgaggtatttgggctgcatagatgtggaatcgttgaagaccgaagtgaaagtgcagcatgcgtttttcttgggcttagcagctttgctgggagagggagtttacaatctcggagagcttctggcccatcctgtattagagtctctgaaggcaaccgagaatgcttggctcatcgagcttttgtacgccttcaattccggaaacataaggaaattcgaagccatgaaaactcagtggtcgtctatagccgatttggccaccgaggaactattcttaagacagaagatatccttattatgtctgatggagatgacatttaacagaccgtcccataacaggcagttaacatttgcggaaatttcaaaagaaacgaggttacctctcaatgaaattgagctgctggtaatgaaggcgctttcacaaggcttagttaaaggggcaattgatcaggttgccagtacggtaaacatgacatgggttcaaccgagagttttagatcgcactcagatctccagtatggtaacaagactcaatgattggtgcaaacatgttaatacaatggagcaattattagaggaaaaagccagtgaaatattaactttgtag

SEQ ID NO: 99 - DNA, 1188 bp, Phyllotreta atra; identical to SEQ ID NO: 98
  misc_feature: Rpn9

SEQ ID NO: 100 - DNA, 1188 bp, Phyllotreta atra; identical to SEQ ID NO: 98
  misc_feature: Rpn9

SEQ ID NO: 101 - DNA, 1188 bp, Phyllotreta atra; identical to SEQ ID NO: 98
  misc_feature: Rpn9

SEQ ID NO: 102 - DNA, 1188 bp, Phyllotreta atra; identical to SEQ ID NO: 98
  misc_feature: Rpn9

SEQ ID NO: 103 - DNA, 1188 bp, Phyllotreta atra; identical to SEQ ID NO: 98
  misc_feature: Rpn9

SEQ ID NO: 104 - DNA, 1188 bp, Phyllotreta atra; identical to SEQ ID NO: 98
  misc_feature: Rpn9

SEQ ID NO: 105 - DNA, 1188 bp, Phyllotreta atra; identical to SEQ ID NO: 98
  misc_feature: Rpn9

SEQ ID NO: 106 - DNA, 594 bp, Phyllotreta atra
  misc_feature: Sar1
caattaatcgaaatgttcatatgggattggttcacgggagtgctgggatacttaggattatggaagaagtccggaaaattgctctttttaggactggacaacgctggtaaaacgaccttattacatatgcttaaagatgatagactggcccagcacttgcccacattgcatccgacctccgaggaattgtccatcggaaacatgaggtttaccacgttcgatctaggaggccattcgcaagcccgaagagtgtggaaggattacttcccagccgtagatgctatcgtatttcttattgacgctaacgacagatcgagattcgtagaaagcaagcaggaattagatgccctgttaacggacgagactctagccaattgccccgtgttgattctaggcaataaaatcgatctgccggacgccgcctctgaggatgaattgcgaaacgtttactcgttgtatggccaaacgaccggtaaaggtaaagtcgctcggtccgatctacccggaaggcctctcgagcttttcatgtgctccatattgaagaggcagggatacggggagggttttcgttggttggcgcagtacattgattaa

SEQ ID NO: 107 - DNA, 594 bp, Phyllotreta atra; identical to SEQ ID NO: 106
  misc_feature: Sar1

SEQ ID NO: 108 - DNA, 594 bp, Phyllotreta atra; identical to SEQ ID NO: 106
  misc_feature: Sar1

SEQ ID NO: 109 - DNA, 594 bp, Phyllotreta atra; identical to SEQ ID NO: 106
  misc_feature: Sar1

SEQ ID NO: 110 - DNA, 594 bp, Phyllotreta atra; identical to SEQ ID NO: 106
  misc_feature: Sar1

SEQ ID NO: 111 - DNA, 1536 bp, Phyllotreta atra
  misc_feature: VATPase B
ttttttgcggtttgtgttagacgtatcgttcttcacgcagagaagatgtcttacccatcgacgttaaacgcaaaacaggccgcacaggagcacgttttggccgtgtccagagacttcgtatcccagccgaggctcacttacaaaacagtgtctggtgtcaacggaccgttggtaatcctcgaagatgtcaaatttccgaaattcaacgaaatcgtccagctcaaactggccgatggcagtctacgatccggtcaagtattggaggtgagcggctccaaagccgtagtacaagtgttcgaaggtacttcgggaatcgacgccaaaaacaccgtgtgcgaattcaccggcgacattctcagaacccccgtgtccgaagacatgctgggcagggtgttcaacggctcaggaaaaccgatcgataaaggacccccgattttggccgaggacttcttggacatccaaggtcaaccgatcaacccttggtcgcgtatctacccggaggagatgatccagaccggtatctccgccatcgatgtgatgaactcgatcgctcgtggccagaagatccccatcttctcggcggccggtctgccccacaacgaaatcgccgcccaaatttgtagacaagccggtcttgtcaaggtgcccggcaagtcggctttggacgatcacgaagacaacttcgccatcgtgttcgccgctatgggagtcaacatggaaacggctcgtttcttcaaacaagatttcgaggagaacggttcgatggagaacgtatgtttgttcttgaatttggccaacgatcctactattgagagaatcatcacgccccgtttggctctaacggctgccgaatttttggcctatcaatgcgagaagcacgtgttggtcatattgactgatatgtcttcgtacgctgaagctttgcgtgaggtatccgccgccagggaagaagtgcccggtagacgtggtttccccggttacatgtacaccgatttggccaccatttacgaacgagccggacgtgtggagggccgcaacggctccatcacccaaatccccatcttgaccatgcccaacgacgatattactcacccgattcccgatttgaccggttatattaccgaaggacagatctacgtcgaccgtcagctgcacaacaggcaaatttacccaccgatcaacgtcttaccgtcgctgtctcgtctcatgaagtccgccatcggcgagggaatgaccaggaaagatcactctgacgtttctaaccagttgtacgcttgctacgccattggtaaggacgtccaggcgatgaaggccgtggtgggagaggaggccctgacgcccgacgatttgctctacctggagttcctgaccaagttcgagaagaacttcatatcgcagggcagctacgagaaccgtacggtgttcgaatcgctggacatcggctggcagttgttgcgtatcttccccaaggaaatgttgaaacgtatcccggccgccacgttggccgaattctacccgagggactcgcgtcactag

SEQ ID NO: 112 - DNA, 1536 bp, Phyllotreta atra; identical to SEQ ID NO: 111
  misc_feature: VATPase B

SEQ ID NO: 113 - DNA, 1536 bp, Phyllotreta atra; identical to SEQ ID NO: 111
  misc_feature: VATPase B

SEQ ID NO: 114 - DNA, 1536 bp, Phyllotreta atra; identical to SEQ ID NO: 111
  misc_feature: VATPase B

SEQ ID NO: 115 - DNA, 1536 bp, Phyllotreta atra; identical to SEQ ID NO: 111
  misc_feature: VATPase B

SEQ ID NO: 116 - DNA, 1536 bp, Phyllotreta atra; identical to SEQ ID NO: 111
  misc_feature: VATPase B

SEQ ID NO: 117 - DNA, 1536 bp, Phyllotreta atra; identical to SEQ ID NO: 111
  misc_feature: VATPase B

SEQ ID NO: 118 - DNA, 1536 bp, Phyllotreta atra; identical to SEQ ID NO: 111
  misc_feature: VATPase B

SEQ ID NO: 119 - DNA, 1536 bp, Phyllotreta atra; identical to SEQ ID NO: 111
  misc_feature: VATPase B

SEQ ID NO: 120 - DNA, 1536 bp, Phyllotreta atra; identical to SEQ ID NO: 111
  misc_feature: VATPase B

SEQ ID NO: 121 - DNA, 2424 bp, Phyllotreta atra
  misc_feature: Vps2
ataaatatcctacaacaacaacaacagcagcagcagcagcaacaacagcagaaccatccgatcggagacgtcaacgatatgaacaacatgaacgtctacgtgatgaaagataacggtatgcccgccaccatgtcgacgtgcgcttgggataagccgttggggccccagttgaggaaagtggagcacgacggtatgctcggaccgtccatggacgccgttaaggctttggaatccgctcattcgccttcgcaaggagtcacgagtcctggcaatgaaaagatgatcggaaaaaccagtccgctgcaagacaaaagcctgctcgacggcagcacgccccctgtaaatacgataatattcgaaaacaccaacttcaaatcggcgcccggttcgcgaaacgccggccgtccggacagtaagccgcgttcaaaattagacgatggctctacagacaattctgtgatttctagttttaataaacccaacatgaacgatctgctgcaagcgaagccggacaaatcggacagcatgccgctgcagctgttcaaggaggactcggccgacatgaaattggactttttcaccgccgatctgcaattcgccgaggacaagagttcgaagaacttcgcctcgaaacccatccatacgatgaccggcggtaacaatacggtcgacagtttggattacaagatcgcgtcggtgaaaaaagtgtgggagacatccgaacaggagaacgacgagaatcagatcgggttctccggcacgcctctggattcgaacgttttcgcccaagggaaggacactccggatgataatcacgaagtgtacagcccgtcgccgagccaaagcgtgtctacgaccaccaacgtttgcaaggtatctggtagcggtcagactgcactatcttccacccatcagacgcacaccggtatagtggccgccggtctcatgggaaacccactgtctccgccgccgatgcagcctgttttgggcgccaatgtgggcatgaatcctcaatacacggccaatcaacacatcggctaccaggcgaatctatcgggcagcacccaatacggcatatccgccatcccctcgcccccgaccgtcccgctggtgtacaattcgacgcagcaaatccaagccgccgcccaatcggccggcctgtacggcgccttccagatcgaccagctgggcggccagggccgctcgcagtactcgcaataccacaactaccacggcctcggccagacggccaacagcccctattcgacgcagaacgtctttttgccgacggcggcgccgccgccgccgccctccgcgcccgagctgtacccgagcatcagcaattaccgcatgagcgccgccggccccttcggccagaaccagcagctgaacaatcccaccacggtgttgatcagctcgacgagcaatagcctgatgtccgcttcggtgaagcccagcagccaaccaatcagcgctatcggaacgaaagcaggcggggtgggacaggcctatcaacagcaatcccagcagggccagcaggtgtatatggcctacgatccgacgattcaggcgaattatctggcctcgagcggcggggttatgcagcgagctcccgttgcgcaggcgcaaaataacgtagtgcctggattgcaaccgtcgtcgtcgttttattcaggatcaacaggcggccaaacgggctactaccagcaacaggcgagctcttcgatcggctcccaaatgcaacagcatcaaggcggctacggcatgcagggcaacgttttcggcacccacaatcaatcgcacgccaacaccggcatgcagaacttcaactcgcactttctgaccacccccatcgtggcggccgccctcaacgctcaagcgcaacaattccgctccggcctgccggccagctacatgaagggcgtcaacagccaccagatcggcgaccaatcgggcaggccgcagcaattgaagagccccagcagccaggaggtgttgtcttcggtcttcaatacaggtcctcagattccctcgccgaaatcgagacagaacaataaacatcccccgccgcaatcgagcccgacggcccaacagaaatataatttgtatcaaggcgtaggcgggccccaaagctctaatatgcaaaggtatccgacgcctattcagagacccgtaaatttccaagtacagcagaattcagcgaatcaaaagcataggaatacatccaacaaaacacccaaccgacagtattatggtaatcagagccaaaacgagaagtctgaggaagggaaaatgaacgacaacaccaacacggcgggaacagtgaaaacggttttgggaacgagctccggttgttcggtggcggctcccgcagagaaaattaaggacagcattaaagaggagcctgctatgttgaaagactaa

SEQ ID NO: 122 - DNA, 2424 bp, Phyllotreta atra; identical to SEQ ID NO: 121
  misc_feature: Vps2

SEQ ID NO: 123 - DNA, 2424 bp, Phyllotreta atra; identical to SEQ ID NO: 121
  misc_feature: Vps2

SEQ ID NO: 124 - DNA, 2424 bp, Phyllotreta atra; identical to SEQ ID NO: 121
  misc_feature: Vps2

SEQ ID NO: 125 - DNA, 2424 bp, Phyllotreta atra; identical to SEQ ID NO: 121
  misc_feature: Vps2

SEQ ID NO: 126 - DNA, 2424 bp, Phyllotreta atra; identical to SEQ ID NO: 121
  misc_feature: Vps2

SEQ ID NO: 127 - DNA, 2424 bp, Phyllotreta atra; identical to SEQ ID NO: 121
  misc_feature: Vps2

SEQ ID NO: 128 - DNA, 2424 bp, Phyllotreta atra; identical to SEQ ID NO: 121
  misc_feature: Vps2

SEQ ID NO: 129 - DNA, 702 bp, Phyllotreta atra
  misc_feature: Vps20
ggagaagcatattttcaaacagactttacgatgggtatcatttttggtaagaagaaaaagccgagtagagtaacagaacaagacaaagctgtattgcaattaaaacagcagagagataaagtaaaacagtaccaaaggagaatagaattatcccttggtaaggacagagagttagctaaaaaactattgaataatggccaaaaggacagggctaaattactgcttaaaaagaaacggtaccaagagcaactcctatcaaagcttgataatcaactgaacaatctagaaaacttggctggtgatattgaattcgcccaagtggaaacacaagtcgtagaaggccttagaacaggcaatgaagcccttaaaaccatcaatgctgctatgaacattgaagatatcgaacgaatattagatgaaacgagagaaggggtagataaacaaaatgaaatcaacgaattacttagcggccaactaacagatgaagatgaggcagctgttgaagaggaattagcagcaataattagcgaagatttgcccacagtgcctatggaacagcctgaagtacaagttaacgaaactgccaaagaagaagaagatgaaggggaagtagtaacggatgaggaggaggaagaaaaggagaaggtcaagaaaccaaaaactaaggaaaaagagaaagagaaggttcctgtattagcttaa

SEQ ID NO: 130 - DNA, 702 bp, Phyllotreta atra; identical to SEQ ID NO: 129
  misc_feature: Vps20

SEQ ID NO: 131 - DNA, 702 bp, Phyllotreta atra; identical to SEQ ID NO: 129
  misc_feature: Vps20

SEQ ID NO: 132 - DNA, 702 bp, Phyllotreta atra; identical to SEQ ID NO: 129
  misc_feature: Vps20

SEQ ID NO: 133 - DNA, 702 bp, Phyllotreta atra; identical to SEQ ID NO: 129
  misc_feature: Vps20

SEQ ID NO: 134 - DNA, 702 bp, Phyllotreta atra; identical to SEQ ID NO: 129
  misc_feature: Vps20

SEQ ID NO: 135 - DNA, 702 bp, Phyllotreta atra; identical to SEQ ID NO: 129
  misc_feature: Vps20

SEQ ID NO: 136 - DNA, 702 bp, Phyllotreta atra; identical to SEQ ID NO: 129
  misc_feature: Vps20

SEQ ID NO: 137 - DNA, 702 bp, Phyllotreta atra; identical to SEQ ID NO: 129
  misc_feature: Vps20

SEQ ID NO: 138 - DNA, 702 bp, Phyllotreta atra; identical to SEQ ID NO: 129
  misc_feature: Vps20

SEQ ID NO: 139 - DNA, 702 bp, Phyllotreta atra; identical to SEQ ID NO: 129
  misc_feature: Vps20

SEQ ID NO: 140 - DNA, 711 bp, Phyllotreta atra
  misc_feature: Vps24
acattagtattttttaaaaacagcaaaaactcgggaaacatgggacttttcgggaaaacgcctgagaggagtccgaaagacttggttacagagtggaaccacaaactgcgcaaggaaggctaccaactggaaaggcaaatacgatccatccagcgagaagaagaaaaagtcaagcgatccctaaaggaagcagccaagaaaaacgacaaggacacctgcctgatattagccaaggaaatcatcaactctcgcaaagccatcaacaagatctacacgtccaaagcccacctcaactccgtaatgctacaaatgaagaaccaattagccactctcagggtgtcgggctcgctgcaaaaatccacggaggtcatgcagacgatgcagaggctcgtacgcgtgccggaggtggcgcagacgatgcaagacatgtccaaagagatgatgaaagccggcatcatcgaggagatgctggacgaaaccatggaggatctcgaggactccgaggagatggaggaagcggcgcaaaccgagatagataaagtgttgttcgagataacggaagggaagatcggggaggcgccgctgccgccgcaggagctggccgagaaggtgactccggtgccggcgacgtcggtggaggagcccgaggaggaggagaacgaagaggagatttcggagatgcagagtcgcttggctgcgctcaaatcgtaa

SEQ ID NO: 141 - DNA, 711 bp, Phyllotreta atra; identical to SEQ ID NO: 140
  misc_feature: Vps24

SEQ ID NO: 142 - DNA, 711 bp, Phyllotreta atra; identical to SEQ ID NO: 140
  misc_feature: Vps24

SEQ ID NO: 143 - DNA, 711 bp, Phyllotreta atra; identical to SEQ ID NO: 140
  misc_feature: Vps24

SEQ ID NO: 144 - DNA, 711 bp, Phyllotreta atra; identical to SEQ ID NO: 140
  misc_feature: Vps24

SEQ ID NO: 145 - DNA, 711 bp, Phyllotreta atra; identical to SEQ ID NO: 140
  misc_feature: Vps24

SEQ ID NO: 146 - DNA, 2172 bp, Phyllotreta atra
  misc_feature: Vps27
aatcacttttctttcagaatgtttcgccacaggaattttgatactttgcttgaaaaagcgactagccatttgttaatggagcaggatttggtatctacgctgcaaatgtgcgacttgattagacaagatgatattcagccgaaatttgctttgaattcattaaagaagaaactcagttcagaaaatcctcatacagctttatatgccctactggttttggaaagcatggtaaaaaattgtggcactgtatttcatgaagaattaacgactaaaccattctgtgatttcctacatgagttgtcgaaaactaccccacacgaaaatgtccgcagtaaacttcttgagttgattcaaacttggaatttcgcattcagaaaaaatcctaagcatggtgctctcaaggaccttatgaatacaatgaaaatggaaggtcgtaagttccctgcgcttcgagaatcggacgcgatgttttcgtccgatacggctccagaatgggctgacggcgacgtttgccacagatgcagagtgcaattcagcgtgctacagagaaaacaccattgcagagcctgcggtcaagtattttgtggacagtgcacttctaaaacgtctactttacccaaatacggaatagaaaaagaggttagagtttgcgacgcttgttttgatgaaattatgaaaccctcatctgcgccgaagtccaggggatcaagcgagaccgatttacctgaagaatatttgaacagctctttggcacaacaaaaacaagatccgcctaaaaaaagcgacgaagaattaagggaagaagaggaattacagttagcattggctttgagccagtctgaagcggaggctaaagaaaaagaaaaaacccgatctacaactactttatattctgcaaaagctgaaccgatgcctgttgagagaccgcaatctccacctcaacaagtagaatcgaatacggagttagccaaatatctaaacagatcttactgggaatctcttaaatccaacgaccaaaacgatcgtcctatgagtccatccgcgccggccacagctcctcttcagaacatcgacggtaaatttaaaactagagaaaacggtttgggcgacaacgatctggaagatttcatgaagactttaaagggtcacgtcgaaattttcattaacagaatgaaaagtaactccagcagagggaggtctatcgcgaatgacactagcgtacaaactttgttcatgaacataacagctatgcattctcgattgcttcattatattcaagagcacgacgacagccgcatccattacgagtgcctacaggataaaatgacccaagtgaaggacgcaagagcggctttggatgctctccgcgaagaacataacgaaaaattgagaagagaagctgaggaacaggagaggatgcgccaaatgcaaatggcgcacaagttggatgttatgaggaaaaagaaacaggaatatcttcaataccaaagacagttggcgctccaaaggattcaagagcaggagagggaaatgcagatgagacaagaacaacagaaacagcagtatatgatgcctcaatatggttatattagctctcctgtgcacggacaaccttttccccctaacgctggacctcctatgagcaactacaacacttatccatttccacaacacatgatgtcgtctcaaaatatgccgaatcaagttgctgtagctgtgacaggaggcccatctgcccatggtcctcctgctggctatcctcaaggttcctcgcacgcgaataacaatcctcaattcgtgggcgtctcggccccgcacatgatggcagcaggattgcccaatatgccgggcaaccaacagggaatgcctcccaatgcaggaataccgcaacaagggatgccgccgcaaaatcaacccaatttgccgccccaacagcagggcatgcagcaacatcaaggcaatattcctccgaatcagggagtaatgttaccaccgcaaggtgtgccgcagcagggtaggatttctttgccgggaaatattcctcaaaatcaagggatgcagaatcagggaatgcctcagtttcaacagcaacagcctggagctcctcctgctagtccacagatcaaatcgaatggggaagcacaaactgctgaattaattagtttcgattag

SEQ ID NO: 147 - DNA, 2172 bp, Phyllotreta atra; identical to SEQ ID NO: 146
  misc_feature: Vps27

SEQ ID NO: 148 - DNA, 2172 bp, Phyllotreta atra; identical to SEQ ID NO: 146
  misc_feature: Vps27

SEQ ID NO: 149 - DNA, 2172 bp, Phyllotreta atra; identical to SEQ ID NO: 146
  misc_feature: Vps27

SEQ ID NO: 150 - DNA, 2172 bp, Phyllotreta atra; identical to SEQ ID NO: 146
  misc_feature: Vps27

SEQ ID NO: 151 - DNA, 2172 bp, Phyllotreta atra; identical to SEQ ID NO: 146
  misc_feature: Vps27

SEQ ID NO: 152 - DNA, 2172 bp, Phyllotreta atra; identical to SEQ ID NO: 146
  misc_feature: Vps27

SEQ ID NO: 153 - DNA, 2172 bp, Phyllotreta atra; identical to SEQ ID NO: 146
  misc_feature: Vps27

SEQ ID NO: 154 - DNA, 2172 bp, Phyllotreta atra; identical to SEQ ID NO: 146
  misc_feature: Vps27

SEQ ID NO: 155 - DNA, 2172 bp, Phyllotreta atra; identical to SEQ ID NO: 146
  misc_feature: Vps27

SEQ ID NO: 156 - DNA, 2172 bp, Phyllotreta atra; identical to SEQ ID NO: 146
  misc_feature: Vps27

SEQ ID NO: 157 - DNA, 645 bp, Phyllotreta atra
  misc_feature: Vps28
tgtagaatgtctgctaatcacgaaaatcgtccagagctttacgaagaagtaaaactgtatcacaatgcaagggaaagggaaaaatacgataatttagcagatctctacgcagttatcaacacattgcaacagcttgaaaaggcatacattagggattgtgttgttgccaaagagtatactggtgcttgtagtaagctactagttcaatacaaagcagcatttagacaagttaatggagatgagtttcctactgttgatgctttcgttaagaaatataggcttgattgcccggctgccctagaaagaattaaggaagacagacctattactattaaagatgataagggaaatactagtagatgtattgctgatattgtgtccctattcattactgtaatggacaaattgagattagatattcgttctatggatcagttacaccctgatgtgagagatttagtcgataccatgaacagattgagcattttgccgtcggattttgagggcaaacaaaagatttcagaatggttggctacattaaatacgatgcaagtatcagatgaattgtcagaatcacagattagacaactactttttgatcttgagagtgcttatgcctctttcaataaaatattgcacaattaa

SEQ ID NO: 158 - DNA, 645 bp, Phyllotreta atra; identical to SEQ ID NO: 157
  misc_feature: Vps28

SEQ ID NO: 159 - DNA, 645 bp, Phyllotreta atra; identical to SEQ ID NO: 157
  misc_feature: Vps28

SEQ ID NO: 160 - DNA, 645 bp, Phyllotreta atra; identical to SEQ ID NO: 157
  misc_feature: Vps28

SEQ ID NO: 161 - DNA, 645 bp, Phyllotreta atra; identical to SEQ ID NO: 157
  misc_feature: Vps28

SEQ ID NO: 162 - DNA, 645 bp, Phyllotreta atra; identical to SEQ ID NO: 157
  misc_feature: Vps28

SEQ ID NO: 163 - DNA, 645 bp, Phyllotreta atra; identical to SEQ ID NO: 157
  misc_feature: Vps28

SEQ ID NO: 164 - DNA, 645 bp, Phyllotreta atra; identical to SEQ ID NO: 157
  misc_feature: Vps28

SEQ ID NO: 165 - DNA, 1065 bp, Phyllotreta atra
  misc_feature: Vatpase D
aaatttcgattttcgatcatgaaggggtgtctgtttaacatcgacaacggttacttggaaggtttatgccgcggtttcaaatgcggcatattgaagcagtccgattacctcaatttagtgcaatgcgaaaccctggaagatttgaagctgcatttacaaggcaccgactacggcacgttcctggccaacgaaccctccccattgtcagtatccaccatcgatgacaaattgagggagaaactggttatcgagttccagcatatgcgtaaccaagccgtagaacccctgtccacattcctggacttcatcacctacagctacatgatcgacaacataattcttctaatcaccggaactttgcatcaaagacctatcggtgagttgattccaaaatgccaccccctcggcagcttcgagcaaatggaagccatccacgtagcggccaccccggcggaattgtacaacgccgtgttagtagacaccccgctagctccgttcttcgtcgactgcatcagcgagcaggatttggacgagatgaacatcgaaatcatcaggaacaccctgtacaaagcctacttggaggctttcttcaccttctgcaaggagatcggaggcaccactgcggacagcatgtgcgaaatcctggccttcgaagccgatagacgtgctatcatcatcaccatcaactccttcggaacggaattgagcaaagacgaccgcgccaagttgtatccgcgttgcggtaaactccagcctgatggtttggctgctctggctagagctgaggattacgagcaggttaaggctgtggccgagtattacgctgagtattccaaattgttcgagggggctggaaacaatccgggagataagacgttggaggacaaattcttcgagcacgaagtgcgtctgaacatcaacgcgttcatgcagcagttccactttggtgtgttctattcctatttgaagctgaaggagcaggagtgcaggaacatcgtttggatcgcagagtgcgtggctcagaagcacagggccaaaatcgataactacattccgatattctag

SEQ ID NO: 166 - DNA, 1065 bp, Phyllotreta atra; identical to SEQ ID NO: 165
  misc_feature: Vatpase D

SEQ ID NO: 167 - DNA, 1065 bp, Phyllotreta atra; identical to SEQ ID NO: 165
  misc_feature: Vatpase D

SEQ ID NO: 168 - DNA, 1065 bp, Phyllotreta atra; identical to SEQ ID NO: 165
  misc_feature: Vatpase D

SEQ ID NO: 169 - DNA, 1065 bp, Phyllotreta atra; identical to SEQ ID NO: 165
  misc_feature: Vatpase D

SEQ ID NO: 170 - DNA, 1065 bp, Phyllotreta atra; identical to SEQ ID NO: 165
  misc_feature: Vatpase D

SEQ ID NO: 171 - DNA, 2592 bp, Phyllotreta atra
  misc_feature: Vps16A
cgaaaaagcgacgaaaaactgaaaatgtcggcggcaatgttgactgcagaatggtttcttttaggaagagattcatattacaggaaattcgaaatctactccatgtcatggcaaagggaggaaatcaatatggaatcgcttactttttccacggcctcatacggtggtcccatagccaccagaaacaatcgacagaaactgatcaaagtacaaggcggtcatcaaccaatcgtttccgtttattccgcatcaggaaaattcatttcctcctttaaatggactaaacgacccatcgtcaaaatgggctggactaatagggaagaattgctgtgcattttggacgacgccaccgtggtcaaacacgacatgttcggtaaatacctgcacgccttcaacgccgtcggcaggcaaaaggacgtcaaagtgacggacgctaaaatcttcactaattgtcacaatttgacgggcgtcgtcgtcatgacgtccgattggaaattctacgctgtcaataacgtcgatgaaccgaaaagtagacggttgtcggagttgcccagatctgctatccagcctactggttgggcgattgtttctgatgacaataggacggagattttggtggctagaagcttggaattgtacaggttgaaacaggacgaagatcgaaccagttcaatgctggaaccggatataacgaacaaatacacatctataatcaaaatgtcggtgtctttaaacgctagacatttggctttttacacggattccggttttttgtggttgggttcgacagatctgagaacgaaatattgcgaaatcgattgcgattttgttttcaaaccgaaacaaatgttatggtgcggtaacgaagccgtggtcatctattgggaaaaagacaatacgttaatgatagtaagcaagcacggtgaaaaattgaaacacttttacgagtcgacggtgcatttaacgccggaagtggacggcgtcaggatactgtcgaatcaacaacacgaattcctgcaaaaagtaccggaagtggtgcaaaagattttccgaataaacagcaccgaaccgggtagttttttgttggaggcttccaagcaattccagaaaggcagccacaaagccaacgaatacgtttgtttggtgaaaaacgatctggaaacggccgttaatcaatgcatcgaagccgtcagttatgaatttgacgttgacgttcaaaaaatcctactgagagctgctcaattcggcaaatgtttcgtgccgacgatgaagtccgacagttacgtcaacatgtgtcgaattttgagggttttgaacaacgttagagacccgaaaatcggaattcccatcaccattactcaattaaatttcacgaaaaccggtcgatcgtcgatcctcgtacgactcatcgccaggaatcactattatctcgccctgaaaatttcggaatatctaaaactaccgcccagggagggctccacgtatgttttggtgcattgggccaaacataaggtcggtcaaagtcgactcgacgaggagacggtcgccagagagatagccgccaaattgggcgaaaagggtagcggcggcggggtgagttttagcgaaatagcggcgacggcgtcggagtgcggcaggaaaaagttggccatcaagcttttagattacgaatcgaaggcgagcgatcaagtgaaattactattggaattgggcgaaaacgtgccggctttggtcaaagccatcgaaagcggcgatacggatttagtttatactgtcatattgaaattgagagaaaacatgcctttaggggactttaagatgaccatcagaaatttccctatcgctcaatcgctgttcataaaatactgtaaagagcacaacgcgcaggctctaagcgaaatttacattcaagaagacgatttttgcgctcaagccgaacttttcatcaaagactcgctggatgttaagaaaaaccacgcgaaagacgcccttttgtcgtcggccttggaggcgtacaaaaaatcccgcaaagacctcaacgccaccatcgtggaggaacacctgcgcttgtgcaggttccaaagggaattggaggatacgctgccggaggcgcgaggtggaaaattcgccggaaaatccgtacaagacacgtgtaaattactattggaattgaacgaaaccaaattggccgaaaagtttcgcaacgatttcaaaattcccgataaaagatattggtgggcgaaaatcgccagtttggccgatcgaaacgattggatcgaattggagaagttctccaaatggaaaaaatccccgatcggctaccatcccttcgtcgacgtttgtttggcgcacgataaaccgcaggaggcgttgaaatatttacacaaagttggcgaggatgtcaaagtcaaatattacatcaaagcgggacgtttagaggaagcagccgaaatagcctatcaacaaagggacgtccaaagtttgttgtacgttcagggaaaatgtcagggaaatcgattttccgacgaaaatcgacgacgattgatggagaaaatcgcccaaatgatcgcccaaatcgaatcgaaaaaataa

SEQ ID NO: 172 - DNA, 2592 bp, Phyllotreta atra; identical to SEQ ID NO: 171
  misc_feature: Vps16A

SEQ ID NO: 173 - DNA, 2592 bp, Phyllotreta atra; identical to SEQ ID NO: 171
  misc_feature: Vps16A

SEQ ID NO: 174 - DNA, 2592 bp, Phyllotreta atra; identical to SEQ ID NO: 171
  misc_feature: Vps16A

SEQ ID NO: 175 - DNA, 2592 bp, Phyllotreta atra; identical to SEQ ID NO: 171
  misc_feature: Vps16A

SEQ ID NO: 176 - DNA, 2592 bp, Phyllotreta atra; identical to SEQ ID NO: 171
  misc_feature: Vps16A

SEQ ID NO: 177 - DNA, 621 bp, Phyllotreta atra
  misc_feature: Vha26
acaacatcatctgatgataacattacaataaattttataaatcgaatactattttatttcgaccgatgtaaatattatacgatcgcacaaaccccaagcaacctaatcggtgaatttcctgttcacgttacgcccgaacagagcgttacggatttgaggcaccaattgctgcgagatcaagtccaatcgcgcctccagcgtgttgttgatcttcactttgttcttcaacgccagcaaatcgatcccccccgtagtctcctgcgacaagtgcgactcgtcgtcgatcttcaggtgcacctccttgcccgttatgtccttgtacttggtctgcacgttgcccagaatcgacttgaccagctccctgtcctgcgggcgcacgcgcaccgttacttctttctcgaacagctggtagagtccttggaggatgaggctttcgatgatgtggccgtacttcccttggtctttggtgacttcgccgagtcgtttgcgggcgtcttccagcacggaccgaacgtggtcctctctcactttcaacaccttcagtctggcctggttcagcatgttggacgattggattttcttctggagttcgacttgtttctctttcttctcgtagtattc

SEQ ID NO: 178 - DNA, 621 bp, Phyllotreta atra; identical to SEQ ID NO: 177
  misc_feature: Vha26

SEQ ID NO: 179 - DNA, 621 bp, Phyllotreta atra; identical to SEQ ID NO: 177
  misc_feature: Vha26

SEQ ID NO: 180 - DNA, 1938 bp, Phyllotreta atra
  misc_feature: Vha68-2
gaaaatcgtcgatttgctgtacttgatagttcagtgggtgaggttgaattagaaacatcacgtctaatcgccctcgttttcagaacatccacaaaaatgtcgaaagtacgtgttggagacgaagaaaaagagagccagtatgggtacgtccatgctgtatctggtccagtcgtcacagcagaaaagatgtccggatctgctatgtacgaattggtacgtgtgggctacttcgaattagtcggtgaaattatccgtttggaaggagatatggcaactattcaggtctacgaagaaacttccggtgtaactgtcggtgatcccgtgttgagatcaggaaaaccgctatccgttgaacttggtcccggtatcatgggttcgattttcgacggtatccaacgtcctttgaaagacatcaacgttttgaccgaaagtatctacatcccgaaaggtatcaacgtacctgcgctatccagaacagcaaaatgggatttcaaccccattaacataaagttgggttctcatttgaccggtggcgatatctacggtatcgttcacgaaaacacgctggtcaagcacaaaatgcttcttccacctaaagccaaaggtaccgttacgtacatcgcagatcctggaaactacacagtagacgaagttgtgctggaaaccgaattcgacggcgaacgttcgaaatacactatgttgcaagtatggccagtccgtcaagccagaccggtcagcgaaaaattgcccgccaatcatcccttactcaccgggcaacgtgttttggacgctcttttcccttgcgtacaaggcggtactacagctattcccggtgccttcggttgcggaaaaaccgtaatttcccaatcgctatccaaatactccaactccgacgtcatcatctacgtaggttgcggagaaagaggtaacgaaatgtctgaagtattgagagatttcccggaactcagcgtggaaatcgacggtcacaccgaatccatcatgaaacgtaccgccttggtggccaacacctccaacatgcccgtggcggcccgtgaggcctccatctacaccggtatcacgttgtccgagtacttccgtgatatgggttacaacgtgtccatgatggccgattcgacctctcgttgggccgaggctttgagagaaatttccggtcgtttggccgagatgcccgccgattccggttacccggcctacttgggggcccgattggcctcgttctacgagcgcgccggtcgcgttaagtgcttgggtaaccccgatagggaaggctctgtttcgatcgtaggagcagtgtcgccgcctggtggtgatttctctgatcccgtcacttctgctactctcggtatcgtgcaagtgttttgggggttggataagaaactcgcccagcgtaagcatttcccgtctgtcgactggctcagttcttactctaaatacctgagagccttagatgatttctatgacaaaaactttgcggaattcataccgctcagaaccaaagttaaggaaattcttcaagaagaagacgatcttacagaaatcgtgcagctggtaggaaaagcttcattggccgaagctgataaaattacattggaaatcgccaagctgttgaaagaagatttcctgcaacagaactcgtactcatcgtacgacagattctgtcccttctacaaaaccgtgggtatgttgaagaacatgattgggatgtacgatatggcgagacacgccgtagagtcgaccgctcaatctgagaacaagatcacgtggacggtgatcagggattcgatgagcaacattctgtaccaattgagcagtatgaagttcaaggatccggtgaaagacggcgaggcgaagatcaaggcggatttcgatcagctgtacgaggatatccagcaggcgttcagaaatctggaggattaa

SEQ ID NO: 181 - DNA, 1938 bp, Phyllotreta atra; identical to SEQ ID NO: 180
  misc_feature: Vha68-2

SEQ ID NO: 182 - DNA, 1938 bp, Phyllotreta atra; identical to SEQ ID NO: 180
  misc_feature: Vha68-2

SEQ ID NO: 183 - DNA, 1938 bp, Phyllotreta atra; identical to SEQ ID NO: 180
  misc_feature: Vha68-2

SEQ ID NO: 184 - DNA, 1938 bp, Phyllotreta atra; identical to SEQ ID NO: 180
  misc_feature: Vha68-2

SEQ ID NO: 185 - DNA, 1938 bp, Phyllotreta atra; identical to SEQ ID NO: 180
  misc_feature: Vha68-2

SEQ ID NO: 186 - DNA, 1938 bp, Phyllotreta atra; identical to SEQ ID NO: 180
  misc_feature: Vha68-2

SEQ ID NO: 187 - DNA, 2733 bp, Phyllotreta atra
  misc_feature: BetaPrime COPI
aaccgcttaaaaatgccacttcggttagacatcaaaagaaagctaacagcccgttctgaccgggtaaaatgcgtggacctacatcccacggagccttggatgctctgttccctatacagcggcaacataaacgtgtggaaccacgaaaaccagcagctcgtcaaaacattcgaagtgtgcgatctaccggtcagagcggccaaattcgtaccgaggaaaaactggatcgttagtggctccgatgacatgcaaatcagagttttcaattacaacactctagatcgcgtgcacgctttcgaagctcactctgattacgtgcgatccattgttgttcatcccacacaaccttacatactgaccagtagcgatgatatgctgataaagctgtggaactgggaaaaagcgtgggcgtgccaacaagtgttcgaagggcacgtgcattacatcatgcaaatttccatcaaccccaaagacaacaatacgttcgccagcgcttctttggaccgaacaataaaagtttggcagttaggcgcctctactgctaatttcacgttggagggtcacgaaaagggcgttaattgcgtcgattactatcacggtggcgataaaccctacctaatatcgggcgccgacgacaggctggttaaaatctgggattaccagaacaaaacgtgcgtacaaacgttagaggggcacggacagaacgtcacggccgtgtgtttccatccggaattaccgatcgctctcaccggcagcgaagacggcacggttcgagtgtggcacgccaacacgcaccgattagagagcagtttgaactacggtttcgaaagagtatggaccattttttgtctgaaaggttccaataacgtggcgctgggttacgacgagggtagcattctggttaaagtcggtagagaagaacccgctgtgagtatggacgccagcggcggtaaaatcatctgggccagacattcggaactacagcaagctaatcttaaagcgttgcccgaaggtgctgaaataagagacggtgaacgcttgccggtttctatcaaagatatgggcgcttgtgatatctacccgcaaactattcagcacaatccgaatggtagatttgtggtcgtttgtggagacggggaatacattatttacaccgccatggcgctcagaaataaagctttcggaagcgcgcaagaattcgtttgggcgcaggattccagcgaatacgccatcagagaatccggttccactataagaatattcaaaaatttcaaagaaaaaaagaatttcaaatccgacttcggagccgaaggtatatacggcggttatcttttgggggtaaaatccgtctcgggattggctttctacgactgggaaacgttggatttggtcagaagaatcgaaatacagccccgttcgatctactggtcggacagcggcaaattggtgtgtttagccaccgaagatagttattttatactctcctacgacgtggaggaggtccacaaggcgaaagaaaacaaccaagtggccgacgacggcgtggagtccgccttcaatcttctaggcgaagtcaacgagaccgttcgaacggggctttgggtgggcgattgtttcatctacaccaacgccgtgaatcgcatcaattacttcgtcggcggcgaattggtgaccatagcgcacctagacgggcctttgtacgtgctcggctacgtcccgaaagacgatagactgtacttagtcgacaaagaattgcgagtcgttagctaccagttgctactttcggtgttggagtatcaaacggccgttatgagaagagatttctcgacggccgaccgagtgttgccttccatacccaaagaacatagaaccagggtggctcatttcttggaaaagcagggtttcaagcagcaagctttggctgttagtaccgaccccgagcacaggttcgaattggccgtggctttggaggatttgaatacggccaaaatgttggcccaggaggctaacaacccgcagaaatggagccaactggccgatttggcggcctccacgaataatctcgtgttggccaaagagtgcatgcagaaagcccaagattacggtggattgttgctcttagctaccagttctggagatgacgaggtagtgaggacattaggcgaagccacggaagccgagggcaagcataacttggcattcttgtcccacttattagtcggtgacttgaacaaatgtctggacattttgataagcaccggtaggcttcccgaagcggcgtttttcgcgagatcttatcttcccgataaaatttcggaggtggtggacctttggagggcccaattgtcgactgtcaatcagaaagccggccaaagtttggccgatcccaaggattacgaaaatctgtttccagggctgcaagaggccatagcggcgcagaaatatttggaacaaaacgaaccgggtttcattcctgccgcttcggctgtcaccgttacaccgaatcacgacagaaatatgatagcggaggttcaagcgaaagtcaaaaattcaggtgcaagttatttcgataatttgctcggcgaaacaccggttgaacaaacgaacaaaccctctgttgataatgaagaagctgatgaggacgatttggatttggatcttgatggagtgaacattgatgaaaatatagatacaacggatatcaatatagatgacgacttgttaagtgattga

SEQ ID NO: 188 - DNA, 2733 bp, Phyllotreta atra; identical to SEQ ID NO: 187
  misc_feature: BetaPrime COPI

SEQ ID NO: 189 - DNA, 2733 bp, Phyllotreta atra; identical to SEQ ID NO: 187
  misc_feature: BetaPrime COPI

SEQ ID NO: 190 - DNA, 2733 bp, Phyllotreta atra; identical to SEQ ID NO: 187
  misc_feature: BetaPrime COPI

SEQ ID NO: 191 - DNA, 2733 bp, Phyllotreta atra; identical to SEQ ID NO: 187
  misc_feature: BetaPrime COPI

SEQ ID NO: 192 - DNA, 2733 bp, Phyllotreta atra; identical to SEQ ID NO: 187
  misc_feature: BetaPrime COPI

SEQ ID NO: 193 - DNA, 2733 bp, Phyllotreta atra; identical to SEQ ID NO: 187
  misc_feature: BetaPrime COPI

SEQ ID NO: 194 - DNA, 2733 bp, Phyllotreta atra; identical to SEQ ID NO: 187
  misc_feature: BetaPrime COPI

SEQ ID NO: 195 - DNA, 1134 bp, Phyllotreta atra
  misc_feature: Act5C
ttcaaaatgtgtgaagaagaagtcgccgctttagtcgtagacaatggctccggtatgtgcaaggccggtttcgccggagacgacgctccgcgcgccgtctttccctccatcgtcggtcgcccaagacatcaaggagtcatggtcggtatgggtcaaaaagattcctacgtaggtgacgaagcccaaagcaaaagaggtatcctcactttgaaataccccatcgaacacggtatcatcaccaactgggatgatatggaaaagatctggcaccacaccttctacaacgaactccgtgtggctccggaagaacaccccgttcttttgaccgaagctcctcttaaccctaaagccaacagggaaaagatgactcaaatcatgtttgaaaccttcaacacccccgctatgtacgtcgccatccaagccgtactttccttgtacgcttccggtcgtaccaccggtatcgttttggactccggtgacggtgtcacccacaccgtacccatctacgaaggttacgctttgcctcacgccatcctccgtttggacttggccggtcgcgatttgaccgactacctcatgaaaatcctcaccgaaagaggttactcattcaccaccaccgctgaaagagaaatcgtccgtgacatcaaggaaaaactctgctatgtcgcattggacttcgaacaggaaatggccaccgccgccgcttccacctcattggaaaagagctacgaattacccgacggtcaagtcatcaccatcggtaacgagagattccgttgtcctgaggctctattccaaccttccttcttgggtatggaatcctgcggtatccacgaaaccgtctacaactccatcatgaagtgtgacgtcgatatccgtaaggacttgtacgccaacaccgtcttgtccggtggtaccaccatgtaccctggtattgctgaccgtatgcaaaaggaaatcaccgccttggcccccagcacgatcaaaatcaagatcatcgctcccccagaaaggaaatactccgtatggatcggtggatccatcttggcttctctttccactttccaacagatgtggatctccaaacaggaatacgacgacggccctggaatcgttcaccgcaagtgcttctaa

SEQ ID NO: 196 - DNA, 1134 bp, Phyllotreta atra; identical to SEQ ID NO: 195
  misc_feature: Act5C

SEQ ID NO: 197 - DNA, 1134 bp, Phyllotreta atra; identical to SEQ ID NO: 195
  misc_feature: Act5C

SEQ ID NO: 198 - DNA, 1134 bp, Phyllotreta atra; identical to SEQ ID NO: 195
  misc_feature: Act5C

SEQ ID NO: 199 - DNA, 1134 bp, Phyllotreta atra; identical to SEQ ID NO: 195
  misc_feature: Act5C

SEQ ID NO: 200 - DNA, 1134 bp, Phyllotreta atra; identical to SEQ ID NO: 195
  misc_feature: Act5C

SEQ ID NO: 201 - DNA, 1134 bp, Phyllotreta atra; identical to SEQ ID NO: 195
  misc_feature: Act5C

SEQ ID NO: 202 - DNA, 1134 bp, Phyllotreta atra; identical to SEQ ID NO: 195
  misc_feature: Act5C

SEQ ID NO: 203 - DNA, 1134 bp, Phyllotreta atra; identical to SEQ ID NO: 195
  misc_feature: Act5C

SEQ ID NO: 204 - DNA, 1134 bp, Phyllotreta atra; identical to SEQ ID NO: 195
  misc_feature: Act5C

SEQ ID NO: 205 - DNA, 684 bp, Phyllotreta atra
  misc_feature: snf7/shrb
ttttcccttatttccattggaaaaatgagtttctttagtaaaatattcggaggaaaggaaaaagacgagggccctacgcccggggaggccatccaaaagctcagggaaaccgaggacatgttatataaaaaacaagagtttttagaaaagaaaatagaggaatacactttagtagccaaaaagaatgcatcgaagaacaaaagagtggcgcttcaagcgctcaaaaagaagaaacgattggaaaaaacgcaactacaaatagatggaactcttacgacgatcgaaatgcaaagagaggccttggaaggagccagcaccaacacagccgtcttagactccatgaggaacgccgctgaggccctccagaaggcccacaaaaacttgaacgtcgatgatgtccacgatatcatggacgacatagctgaacaacacgatattgccaatgagattacaactgctattagtcaacctgtgggcttcgccgacgatttggacgaggacgaattggaaagcgaactggagaaactggaacaagaaggattagaggaagatttactgaaagttccgggtcctactgaattacccgctgtacctacgggggctatcgctaaaccggttaaacctgctgctaaaaaagtggaggatgatgatgacatgaaggaattggaggcttgggcttcgtaa

SEQ ID NO: 206 - DNA, 684 bp, Phyllotreta atra; identical to SEQ ID NO: 205
  misc_feature: snf7/shrb

SEQ ID NO: 207 - DNA, 684 bp, Phyllotreta atra; identical to SEQ ID NO: 205
  misc_feature: snf7/shrb

SEQ ID NO: 208 - DNA, 684 bp, Phyllotreta atra; identical to SEQ ID NO: 205
  misc_feature: snf7/shrb

SEQ ID NO: 209 - DNA, 684 bp, Phyllotreta atra; identical to SEQ ID NO: 205
  misc_feature: snf7/shrb

SEQ ID NO: 210 - DNA, 684 bp, Phyllotreta atra; identical to SEQ ID NO: 205
  misc_feature: snf7/shrb

SEQ ID NO: 211 - DNA, 684 bp, Phyllotreta atra; identical to SEQ ID NO: 205
  misc_feature: snf7/shrb

SEQ ID NO: 212 - DNA, 684 bp, Phyllotreta atra; identical to SEQ ID NO: 205
  misc_feature: snf7/shrb

SEQ ID NO: 213 - DNA, 2592 bp, Phyllotreta atra; identical to SEQ ID NO: 171
  misc_feature: Vps16A

SEQ ID NO: 214 - DNA, 2592 bp, Phyllotreta atra; identical to SEQ ID NO: 171
  misc_feature: Vps16A

SEQ ID NO: 215 - DNA, 2592 bp, Phyllotreta atra; identical to SEQ ID NO: 171
  misc_feature: Vps16A

SEQ ID NO: 216 - DNA, 2592 bp, Phyllotreta atra; identical to SEQ ID NO: 171
  misc_feature: Vps16A

SEQ ID NO: 217 - DNA, 2592 bp, Phyllotreta atra; identical to SEQ ID NO: 171
  misc_feature: Vps16A

SEQ ID NO: 218 - DNA, 3024 bp, Phyllotreta atra
  misc_feature: Rpn2
aggatgaatattacttcggctgcggggattatatcccttttagaagaaccaagaccagaacttaaagtattcgcgttaagaaaactagactccatagtcgacgaattctggccagaaatttcagaagctattgaaaagatagaaattctgcacgaagacaaagtgtttcaacaacaccagttagctgctttagtcgctagtaaagtatactaccatctgggtgcgttcgaagactcgttaacgtacgctttgggagctggtgatctcttcgacgtaaatgctagaacagaatatgttgaaaccactcttgcaaaatgcatcgacttctatacacaacaacgcatcgccttggcagaaggcgcaaccgatgcgaaacctattgattcgagactcgaagcgattgtaaatcgaatgttccaacgttgtttagatgatggtcaaaaccgccaggctatggggctcgccttagagaccaggagaatggacatcttcgaattatctatcacacaagccgaggatattattagcatgctcacctacgctttccaagtggcgatgagcctaattcagaatagggcatttcgtaacaccgttttaagatcgttggttggcttgtatcgcggtttaactacaccggattacgttaacatgtgccaatgtctaattttcttggacgatgcactgccagtcgcagaaattttggataaattagtgtctggtaaagaagagtccgaattgatggcttaccaaatagctttcgatctgtatgagtctgcaacccaacagtttttggaaagagttttggttgcccttagagctactgctcccattccatcgctgttagaggaaaaggtgaaagctaaagctactgaacaatctagtagcacttcggcagaggctagcaaagatccggttagcagcgaaactaaagtcgaggctaaaaaggaagaaaaatctattgagagtttgactgaaagtgaaaaggaacaccaaaagcgaattgaaaaattgcataccatcctatccggcgaagtatcaatagaacttcatcttcaattcctcattagatctaaccacgccgatcttcttattctgaagcaaaccaaagaaacggttcgagttagtatttgccacactgctacagtcatcgctaacgctttcatgcacagcggtactaccagcgaccaatttctaagggataatttggaatggctagctcgagctacgaattgggcgaaacttacagcaacagcgtctctcggcgtcatccaccgtggacacgaacaagaggctttgacactcatgcaaagctatttgccgaaggaagtcgggccgagttccggatattccgaaggcggtggtttatacgctctgggtcttatacacgccaatcacggtgctaatataatcgattatcttctcggtcaattgaaagacgctcagaatgagatggttaggcacggcggttgtttagggcttggtttggctgccatggggacacacaggcaagatgtctacgaacagctgaagttcaatctctatcaagatgatgctaataccggagaggccgctggaattgcgatgggcatggttatgttaggatccagtaattccactacgattatggatatggtagcgtacgcgcaagagagtcaacacgaaaagattcttcgcggtttggctgttggtataagcttcacgatgtacggccgattagaagaagctgataccctaatacaacagcttacttctgataaggatccaatcctgagaagatccggcatgtatacattagctatggcttattgcggcacgggacacaaccaggcgattagaaaattattacacgttgcggtttctgatgtaaacgatgacgtgagaagagcggcagtcacagcgctcggtttcctgttgttcagaacccccgagcaatgtcccagcgtggtgtccctgttagcggaaagctacaacccccacgtacgttacggcgccgccatggcgctgggcatagcctgcgccggcacgggccttcgcgaggccatagccctgctcgagcccatggtgatgttcgatccggtgaacttcgtccggcagggggccctcatcgcctccgcgatgatcctcatccagcagaccgagcagacctgcccgaaggtcagcttcttcaggcagacctactcccaagtcatctccaacaagcacgaagacgtcatggcgaagttcggcgccatcttggcgcaaggtataatcgacgccggtggcaggaacgtgactctatcgttgcaatccagaactggccacactaatatgctggccgttgtcggtacattggtgtttacgcagtattggtattggttccctctgtcacattgtctggctttagcctttaccccgacgtgcgttatagcgttgaacactcaacttaagatgcctaaactggagttcaaatcgaacgcgaagccgagcttgtacgcctacccggcgcccatggaggaaaagaaacgcgaagaaagggagaaagtcaccactgccgtattgagtatagctgccaggcaaaggagaagggatcacgagaggaaacatcgcgatgagaaaatggatgtggacgaagataaagacgataagaagcccgagaaggaggagaaggagaagaaaaccgaagagaagaaagaggagaaaaagtccgatgataagaaaaccgacgataaaaaagcggcgtcgtcgagcgacgacaaaaaagataagaaagatgataaggaggagaagaaaaaggagcccgagcctagtttcgaaatcctgcaaaatcctgccaggaccatgaggcaacagctgaaagtgattacgcttaatgataactcgcaatacgttgcaatgaaggatgtttcgatcggagggattattatggttcgcaatttgaaacctggtgaagaggaattggtggaacccgtagcagcattcggtccaaagggcgatgatgaaaaggaaccagaaccaccagaaccattcgaatggaccgaggattag

SEQ ID NO: 219 - DNA, 3024 bp, Phyllotreta atra; identical to SEQ ID NO: 218
  misc_feature: Rpn2

SEQ ID NO: 220 - DNA, 3024 bp, Phyllotreta atra; identical to SEQ ID NO: 218
  misc_feature: Rpn2

SEQ ID NO: 221 - DNA, 3024 bp, Phyllotreta atra; identical to SEQ ID NO: 218
  misc_feature: Rpn2

SEQ ID NO: 222 - DNA, 3024 bp, Phyllotreta atra; identical to SEQ ID NO: 218
  misc_feature: Rpn2

SEQ ID NO: 223 - DNA, 3024 bp, Phyllotreta atra; identical to SEQ ID NO: 218
  misc_feature: Rpn2

SEQ ID NO: 224 - DNA, 1182 bp, Phyllotreta atra
  misc_feature: Rpt6
aaaccgacgatgactgttatcaataagatggaggtcgacggaggcctgaagggggaaggcttcaggtcgtattacattacgaaaatcgaagaattgcaacttatcgttgccgaaaagagtcaaaaccttcgaagattgcaggcccaaaggaacgaacttaacgccaaagttcgtatgcttagagaagaactgatgttgcttcaagaacaaggaagctacgtaggtgaagtagtaaaaccgatggacaagaagaaagtcctcgtcaaagttcatccggagggaaaatttgtggtcgatatcgataagaatatcgacattaacgatgtcacacccaattgtagagttgctcttcgaaatgaatcttacactttgcacaaaattttaccgaataaggtggatcctttagtgtctcttatgatggtggaaaaagtgccggattccacttacgaaatggtcggtggtctggacaagcaaataaaagaaatcaaagaggtcattgaattgcccgtgaagcatcctgaacttttcgatgccttgggtatcgctcaaccgaagggtgtgcttttatacggtcctccaggaactggaaaaactcttttggccagagcagtggctcatcatacagaatgtacgtttattcgtgtatctggatcggagttggtgcaaaaattcatcggagaaggttccaggatggttagagaacttttcgttatggccagagaacacgcaccttccataattttcatggacgaaatcgattctattggatcttctcgtatcgaatcaggttcgggcggtgattccgaagtccagagaacaatgttggagttgctcaatcaattggacggattcgaagcgacgaaaaacattaaagtcatcatggccaccaacagaatcgatattttagacccggctttgctcagacccggcagaatcgacaggaaaatcgaattcccgccaccgaacgaggaagcccgattggacatcctgaaaattcactctagaaaaatgaatttgaccagaggaatcaatctgaggaaaatcgccgaattgatgccgggcgctagcggtgccgaagtgaagggtgtttgcaccgaggctggtatgtacgcgttaagagagagaagggtgcacgttacccaagaagatttcgaaatggctgtggccaaggtcatgcagaag

SEQ ID NO: 225 - DNA, 1182 bp, Phyllotreta atra; identical to SEQ ID NO: 224
  misc_feature: Rpt6

SEQ ID NO: 226 - DNA, 1182 bp, Phyllotreta atra; identical to SEQ ID NO: 224
  misc_feature: Rpt6

SEQ ID NO: 227 - DNA, 1182 bp, Phyllotreta atra; identical to SEQ ID NO: 224
  misc_feature: Rpt6

SEQ ID NO: 228 - DNA, 1182 bp, Phyllotreta atra; identical to SEQ ID NO: 224
  misc_feature: Rpt6

SEQ ID NO: 229 - DNA, 1182 bp, Phyllotreta atra; identical to SEQ ID NO: 224
  misc_feature: Rpt6

SEQ ID NO: 230 - DNA, 1182 bp, Phyllotreta atra; identical to SEQ ID NO: 224
  misc_feature: Rpt6

SEQ ID NO: 231 - DNA, 1182 bp, Phyllotreta atra; identical to SEQ ID NO: 224
  misc_feature: Rpt6

SEQ ID NO: 232 - DNA, 1182 bp, Phyllotreta atra; identical to SEQ ID NO: 224
  misc_feature: Rpt6

SEQ ID NO: 233 - DNA, 1182 bp, Phyllotreta atra; identical to SEQ ID NO: 224
  misc_feature: Rpt6

SEQ ID NO: 234 - DNA, 1404 bp, Phyllotreta atra
  misc_feature: sec23
ggtcaagttttgaatgacgatttgaaacaacctattagatcccatcatgacatccaaaaagataacgcgaaatacatgaaaaaagctattaaacattacgatactctggctatgagagcggcgactaacggtcattgtattgacatctattcctgcgctcttgatcaaactggtttgatggaaatgaagcaatgcgtcaattctacaggaggtcatatggtgatgggagactcgttcaattcctcgttgttcaaacaaacgttccaaagagtgtttaccagagatcagaaaaacgatttgaaaatggcttttaacggaacattagaagtgaaatgttctcgagaattaaaagtgcaaggaggcattggatcctgtgtatcattaaacgtcaaaagtcaactggtctccgacacagaaatcggcatgggcaacactgtacaatggaaaatgtgtacgcttactccaagcactacgatggccttgttcttcgaagtcgtcaatcagcattctgcaccgattccgcaaggaggaagaggttgcatacaattcattactcagtatcaacactcgagtggtcaaagaagaattagagtgacaacagtggctcgaaactgggctgacgccactactaatatccaccacatcagcgctggttttgatcaagaagcagcagctgtaattatggccagaatggctgtttatagagctgaatcagatgaaagtcccgacgttctgagatgggtcgatagaatgctgattcgattgtgtcaaaaattcggagaatacaataaagacgatgctggttcattcagattgggccaaaactttagcctctatccgcaattcatgtaccatctaaggaggtctcagttcctgcaagttttcaataattctcctgatgaaacgtcgttctatcgacatatgctgatgagagaagatcttactcaatcattgatcatgattcaaccaattttgtacagttacagtttcaacggccctccggagcctgttctattagatacgagttccatacagcccgatagaatactgcttatggacacgtttttccaaattttgatattccacggagagactatagcgcaatggcgaaatttgaagtaccaggatatgcccgaatacgaaaactttaggcaacttttgcaagcgcccgtggacgatgctcaagagatattacaaacgagatttcccatgccgagatatatcgataccgaacaaggaggatcgcaggctagatttttattgtccaaagtcaatccgagtcagactcacaataacatgtattcatatggaggggacgctggcgctccggttttaacagacgatgtatcacttcaagtatttatggatcatttgaaaaaattggcagtttcgtccacggcttaa

SEQ ID NO: 235 - DNA, 1404 bp, Phyllotreta atra; identical to SEQ ID NO: 234
  misc_feature: sec23

SEQ ID NO: 236 - DNA, 1404 bp, Phyllotreta atra; identical to SEQ ID NO: 234
  misc_feature: sec23

SEQ ID NO: 237 - DNA, 1404 bp, Phyllotreta atra; identical to SEQ ID NO: 234
  misc_feature: sec23

SEQ ID NO: 238 - DNA, 1404 bp, Phyllotreta atra; identical to SEQ ID NO: 234
  misc_feature: sec23

SEQ ID NO: 239 - DNA, 1404 bp, Phyllotreta atra; identical to SEQ ID NO: 234
  misc_feature: sec23

SEQ ID NO: 240 - DNA, 1404 bp, Phyllotreta atra; identical to SEQ ID NO: 234
  misc_feature: sec23

SEQ ID NO: 241 - DNA, 1404 bp, Phyllotreta atra; identical to SEQ ID NO: 234
  misc_feature: sec23

SEQ ID NO: 242 - DNA, 1404 bp, Phyllotreta atra; identical to SEQ ID NO: 234
  misc_feature: sec23

SEQ ID NO: 243 - DNA, 1404 bp, Phyllotreta atra; identical to SEQ ID NO: 234
  misc_feature: sec23

SEQ ID NO: 244 - DNA, 1404 bp, Phyllotreta atra; identical to SEQ ID NO: 234
  misc_feature: sec23

SEQ ID NO: 245 - DNA, 2250 bp, Phyllotreta atra
  misc_feature: sec6
ttatcaattaatagaatctacaaaatgactacaaaaaaaattaatatgagagagctggaagctactgctaaagcctcaggaacagccaaagtcattaacacattaaataggccaggccagttagaaaaaatcgaccaaattaagcaaaggtatgttcgaaaaaaagcatctgttgaagcccttctgaaatcggcaatgcaacagcaattggacggggttcgaactggattggtgcagttgcatcgatgtctcgaagaagtttgtgaaatcgatgatagtatgaagaaaatgtctgaattgtttgccgacgtgcctgaactcagcaagaagcttatcgatattagagatgaaaatatgcgtcattcacaatacgtaacagctaaagaaaacctcaagcatatttttactgttccggaaagtgttgagaaaacgaaagcttggattaacgaaggaaaattgcttcatacacatcaatgtttaagggatttagagaactcgagagacgacctactatttgagttacacaaactaccaaatcaatctgtgcatgacaaatcgatgttaaaagcatatttcgccgatgtggaagtactatcgaaattattggagaagcaactaacgttcattttatctagaaccttaaatacagtaagaaaagacccgacagtaatcgtaacagccttgcggatcatagaaagagaagaaaaagcggacgaagaagctttaaagcaacaaaaacaaactggattcattcctccagctcgaccgaagaaatggagagaaatggcttttaaaattttggagaagaccgtgtcatccaaaatcgagggtactcaagttgaagaaagagaggacaataaacattggcttatacgttatttagaactaattagaatgatgatcttagaagatttgagaattgttaaaacactctgtcttccttgttttccaccaagttacaaaatattagacaaatacattcatatgtatcatggtggtctttctgtacatctacaagaaattatacaaaacgggctcaaaggtaacgaatacgttacaatactttcttgggccttgaaaacgtataaatcaaaagacatgttgggccatccagatctaacagcttcaactgaaagtttacctcctttattacctaaagccgtgctagaccatttggaaggagactatttgaaaaatatcgaagggaattacagtgaatggatgcagaacactctcaaatcagaaaaagaggaatggagatcaaatactgaaccgttctcagaatcgtattctcggacaccggcccccattattatatttcaaatgattgatcagaatttgcaagtagccaaaacaataagtgaagaattaacaataaaagtactaaatttaagcatccagcaagtaattatatttgcagatgcttttagagaagcgattatcgaattcaagaataaatattttgaagacaggaaacaagttgtatattttactcaatacatgatcttaattatcaacaatatcctgcaacttgttgaattaggttctcaattggaaaaagaatatgttactaacaacagttcgcatgaacttactaggaattttggagcattaaaagcgacttatattaaaatgagaaacgaggcagtccattatctcttagaagaattatttgtcgactcggaccaacatttcgacaaactgtttacatcacattggttcgcttccaatcctgcggacacaatttatgtaaccatcgaagattacttccaggattacaaccgcttagtggaagcgaattacaaatatttaatcgagcaattaattacctccgtcggtagaaaatacctcacagccatgctgtccaggcgcatatcgtttaaaacttacgaagaatgcacgaaagcagcacaaaaagcgtcggaagaggccaaccgattgaacagattgtttcagacccttagcaaagacatcgaatgcgaaaacccattcgatgccatcattatgctctcggaggtattgaaaagtgatgacgatatgatgtcgtttgagcttcacagagtcgtggaaaaatatcccgatatcacggatgatcatctcctgaggttgctaaatttgagaggcgatctatcaaggtctgaagttagagacaaagttgcgcatatagataaacctaaagttctacacaaaagtacgatttttaggactttgttgtttccaaaacttgtaaatatcaatttgaacttttaa

SEQ ID NO: 246 - DNA, 2250 bp, Phyllotreta atra; identical to SEQ ID NO: 245
  misc_feature: sec6

SEQ ID NO: 247 - DNA, 2250 bp, Phyllotreta atra; identical to SEQ ID NO: 245
  misc_feature: sec6

SEQ ID NO: 248 - DNA, 2250 bp, Phyllotreta atra; identical to SEQ ID NO: 245
  misc_feature: sec6

SEQ ID NO: 249 - DNA, 2250 bp, Phyllotreta atra; identical to SEQ ID NO: 245
  misc_feature: sec6

SEQ ID NO: 250 - DNA, 2250 bp, Phyllotreta atra; identical to SEQ ID NO: 245
  misc_feature: sec6

SEQ ID NO: 251 - DNA, 2250 bp, Phyllotreta atra; identical to SEQ ID NO: 245
  misc_feature: sec6

SEQ ID NO: 252 - DNA, 2250 bp, Phyllotreta atra; identical to SEQ ID NO: 245
  misc_feature: sec6

SEQ ID NO: 253 - DNA, 2250 bp, Phyllotreta atra; identical to SEQ ID NO: 245
  misc_feature: sec6

SEQ ID NO: 254 - DNA, 2250 bp, Phyllotreta atra; identical to SEQ ID NO: 245
  misc_feature: sec6

SEQ ID NO: 255 - DNA, 717 bp, Phyllotreta atra
  misc_feature: Proteasome alpha 2
tcatttgtgaaaatgtcatctgaacgttatagtttttctttaacaactttcagcccttcaggtaaactagtccaaatcgaatatgctttagcggcagtagcggctggtgctccgtcagtaggaataaaagcatcaaatggagtggtaatagccacggaaaacaagcacaaatccattctttacgacgaacacagcgtccacaaagtggaaatgatcacgaagcacatcggaatggtctattccgggatgggacccgactaccgtttgttggtcaagcaagcgcgtaaaatggcccaacagtattacctggtttacaaagaaccaattcctactgttcagctagttcaacgtgtagccactgtgatgcaggaatacactcaatccgggggagttagacccttcggagtgtccctgttgatctgcggatgggacaacaacaggccttacttattccagtgcgatccttccggggcgtatttcgcttggaaagccaccgcaatgggaaagaattacgtcaacgggaagaccttcctcgagaaaaggtatagcgaagagttggaattggatgatgctgtgcacaccgccattttaacgcttaaagaaagtttcgagggccaaatgaccgctgataacatcgaggttggcatatgcgatccacaaggatttaggagattcgatccttctacagtaaaagattttttggcaaatattccttaa

SEQ ID NO: 256 - DNA, 717 bp, Phyllotreta atra; identical to SEQ ID NO: 255
  misc_feature: Proteasome alpha 2

SEQ ID NO: 257 - DNA, 717 bp, Phyllotreta atra; identical to SEQ ID NO: 255
  misc_feature: Proteasome alpha 2

SEQ ID NO: 258 - DNA, 816 bp, Phyllotreta atra
  misc_feature: Proteasome beta 5
attacaagctacaattccgaggattacgagcgactcgcctacgacgagagcctgcagaagtattgcaccaatttcaagaatggcatgaacttagctgttcccccttttcctgatcccagcaacaactttgcaaggttcaccaaagatgataacggccgtgagatcaaaatcaagttcgaccacggtaccaccacattgggattcatgtacaaagggggcgtagtgctcgcagtggattcccgagccactggcggccaattcattggatcacaaactgtagagaaaatcataaaaatcaacagttttctactagctacaatggcaggaggcgcggctgattgcacctactgggaccgagtattagctaaacaatgtaggctgtacgagctgagaaacagggaacgtatctcggtggctgcggcttccaagttaatggccaacatggtttataattacaagggaatgggcttgtccatgggaatgatgctggctggatgggacaaaaggggtcctcaactctactatgtcgattcagaaggtctaaggacagccgggaaagtgttcagcgtaggttcgggttccatttacgctttcggggtgctggattctgggtacaaatgggacttatccgatgaggaagcttatgatttaggtcgtagatcgatttaccacgctactcacagagacgcctattcaggtggtattgttagagtgtaccacatgaaggagactggctgggtgcacatcgatgataatgattgcatggacttgcattacaagtttgtggaggaaaaggagaagatgggtggcgcttga

SEQ ID NO: 259 - DNA, 880 bp, Phyllotreta atra; identical to SEQ ID NO: 2
  misc_feature: Proteasome beta 5

SEQ ID NO: 260 - DNA, 880 bp, Phyllotreta atra; identical to SEQ ID NO: 2
  misc_feature: Proteasome beta 5

SEQ ID NO: 261 - DNA, 880 bp, Phyllotreta atra; identical to SEQ ID NO: 2
  misc_feature: Proteasome beta 5

SEQ ID NO: 262 - DNA, 880 bp, Phyllotreta atra; identical to SEQ ID NO: 2
  misc_feature: Proteasome beta 5

SEQ ID NO: 263 - DNA, 880 bp, Phyllotreta atra; identical to SEQ ID NO: 2
  misc_feature: Proteasome beta 5

SEQ ID NO: 264 - DNA, 880 bp, Phyllotreta atra; identical to SEQ ID NO: 2
  misc_feature: Proteasome beta 5

SEQ ID NO: 265 - DNA, 880 bp, Phyllotreta atra; identical to SEQ ID NO: 2
  misc_feature: Proteasome beta 5

SEQ ID NO: 266 - DNA, 880 bp, Phyllotreta atra; identical to SEQ ID NO: 2
  misc_feature: Proteasome beta 5

SEQ ID NO: 267 - DNA, 606 bp, Phyllotreta atra
  misc_feature: RpL19
aaaatgagttcgttaaaactccagaagaggctcgcagcctctgttatgagatgcggcaaaaagaaggtatggttggatcccaacgaaatcaacgaaatcgccaacacaaattcacgacaaaacatccgcaagctgatcaaagacggtctgatcatcaagaagcccgtggcggtgcactcgcgcgcccgcgtccgcaagaacaccgaagcccgcaggaagggcaggcactgcggtttcggtaaaaggaaaggtacagcgaacgctcgaacaccaagaaaagaattatggattcaacgtatgagggtgctccgtcgtttgttgaagaagtaccgcgaggccaagaaaatcgacaggcatctgtaccattcgctgtacatgaaggcgaagggtaacgtgttcaagaacaagcgcgtcctgatggaatacatccacaagaagaaggccgagaaggcgcgcgccaagatgttggccgaccaggcgaacgccaagagaatgaaggtgaaacgggccagggagagacgcgaagaacgtatcgctacgaagaagcaggaagttttgcagaattaccagcgggaagacgaagctgccgctgctactaaaaaatag

SEQ ID NO: 268 - DNA, 606 bp, Phyllotreta atra; identical to SEQ ID NO: 267
  misc_feature: RpL19

SEQ ID NO: 269 - DNA, 606 bp, Phyllotreta atra; identical to SEQ ID NO: 267
  misc_feature: RpL19

SEQ ID NO: 270 - DNA, 606 bp, Phyllotreta atra; identical to SEQ ID NO: 267
  misc_feature: RpL19

SEQ ID NO: 271 - DNA, 606 bp, Phyllotreta atra; identical to SEQ ID NO: 267
  misc_feature: RpL19

SEQ ID NO: 272 - DNA, 606 bp, Phyllotreta atra; identical to SEQ ID NO: 267
  misc_feature: RpL19

SEQ ID NO: 273 - DNA, 1281 bp, Phyllotreta atra
  misc_feature: RpL3
cgttttactttatctgccatttcatttttcgacgtcaacatgtcgcacaggaagtttagtgcaccccgtcacggatctatgggattctaccccaagaaaagatcccaaaggcaccgtggtaaagtaaaggctttccccaaagatgacccctcgaaacccgtccatttaacagctttcattggctacaaagccggtatgacccacgtgctacgtgaggcagacaggcctggttcgaaaatcaacaagaaggaaatcgtagaggctgtgaccattttggaaacccctccgatgattgtagtaggcgttgtgggttacatcgaaactccacatggcatgagggctttggccaccgtttgggctgaacatttgtctgaagattgccgtagacgtttctacaagaactggtacaagagcaagaagaaggccttcaccaaggcatccaagaaatggaccgacgatttgggtaaaaagtcaattgagcgcgacttgaagaaaatcgtcaaatactgcaaggttgtcagagtcatcgctcacactcagatgaaattgttgaaacaacgccaaaagaaagcccacattatggaaattcaactcaacggcggtaccattgccgacaaagtggcatgggctaaggagcatttggagaagcccattcccgttggcaacgttttcgctcaagatgagatgatcgattgcatcggtgtaaccaaaggtcatggatacaaaggtgttacatctcgttggcatacgaagaaattgccccgcaagacgcacaagggtcttaggaaagtcgcctgtattggagcctggcatccttctcgagtgtcgttcactgtcgctcgtgctggtcaaaagggttaccatcacaggacggagatgaacaagaaaatctacagaatcggcgctggaattcacactaaggacggaaaggtcatcaaaaacaatgctgctaccgattacgatcttagtgagaaaactattacaccgatgggtggtttccctcattacggtgaagttaacaacgacttcgtcatgattaagggttgttgtattggacctaagaagcgcgtcattacactgagaaaatctctcttggttcacactaagcgtattgctttggagaagatcaatttgaaattcatcgatacgtcgtccaaattcggacacggtagattccaaaccgccgccgacaaggctgcgttcatgggaccccttaagaaagatagagttaaggaagaagacaagactgcggctccagctgcagctgctgcttcgagttaa

SEQ ID NO: 274 - DNA, 1281 bp, Phyllotreta atra; identical to SEQ ID NO: 273
  misc_feature: RpL3

SEQ ID NO: 275 - DNA, 1281 bp, Phyllotreta atra; identical to SEQ ID NO: 273
  misc_feature: RpL3

SEQ ID NO: 276 - DNA, 1281 bp, Phyllotreta atra; identical to SEQ ID NO: 273
  misc_feature: RpL3

SEQ ID NO: 277 - DNA, 1281 bp, Phyllotreta atra; identical to SEQ ID NO: 273
  misc_feature: RpL3

SEQ ID NO: 278 - DNA, 1281 bp, Phyllotreta atra; identical to SEQ ID NO: 273
  misc_feature: RpL3

SEQ ID NO: 279 - DNA, 1281 bp, Phyllotreta atra; identical to SEQ ID NO: 273
  misc_feature: RpL3

SEQ ID NO: 280 - DNA, 573 bp, Phyllotreta atra
  misc_feature: RpL40
agaatgcagatcttcgtgaaaaccctgactgggaaaaccatcaccctcgaggtggagccgtccgataccatcgagaacgtgaaagcaaaaattcaagacaaagaggggatcccaccagatcagcaacgtttgatctttgccggcaaacaactggaagatggaagaaccttatctgactacaatattcaaaaagaatctactctacatttagtacttcgtctccgtggagggatgcaaatattcgttaaaacccttactggtaaaactataaccctcgaagttgaaccatctgatactattgagaacgttaaggcgaaaatccaagacaaagaggggattcctccagatcagcaacgtttaatcttcgccggtaaacaactggaagatggcagaacattgtctgactacaatattcaaaaagagtccacactgcatttagttcttcgtctacgtggaggaatgcaaatattcgttaaaactcttactggtaaaacaattactcttgaagttgaaccatctgatactatcgaaaatgttaaggccaaaattcaagacaaagagggaattcctcca

SEQ ID NO: 281 - DNA, 573 bp, Phyllotreta atra; identical to SEQ ID NO: 280
  misc_feature: RpL40

SEQ ID NO: 282 - DNA, 573 bp, Phyllotreta atra; identical to SEQ ID NO: 280
  misc_feature: RpL40

SEQ ID NO: 283 - DNA, 573 bp, Phyllotreta atra; identical to SEQ ID NO: 280
  misc_feature: RpL40

SEQ ID NO: 284 - DNA, 255 bp, Phyllotreta atra
  misc_feature: RpS21
aacatggaaaacgacgctggtgaaaccgtcgacttgtactgcccaaggaaatgctctgctagcaacagaattattcatgctaaggaccacgctagcattcaactcagcgtagccgatgtcgatcctttaaccggaaggatgaccgaaagttccaaaagctacgccctctgcggagctatcaggcgtatgggagaatcggacgattgtattgtgaggttaacgaagaaagatggaatcttagccaaaaacttctaa

SEQ ID NO: 285 - DNA, 591 bp, Phyllotreta atra; identical to SEQ ID NO: 7
  misc_feature: RpS4

SEQ ID NO: 286 - DNA, 591 bp, Phyllotreta atra; identical to SEQ ID NO: 7
  misc_feature: RpS4

SEQ ID NO: 287 - DNA, 591 bp, Phyllotreta atra; identical to SEQ ID NO: 7
  misc_feature: RpS4

SEQ ID NO: 288 - DNA, 591 bp, Phyllotreta atra; identical to SEQ ID NO: 7
  misc_feature: RpS4

SEQ ID NO: 289 - DNA, 591 bp, Phyllotreta atra; identical to SEQ ID NO: 7
  misc_feature: RpS4

SEQ ID NO: 290 - DNA, 591 bp, Phyllotreta atra; identical to SEQ ID NO: 7
  misc_feature: RpS4

SEQ ID NO: 291 - DNA, 591 bp, Phyllotreta atra; identical to SEQ ID NO: 7
  misc_feature: RpS4

SEQ ID NO: 292 - DNA, 591 bp, Phyllotreta atra; identical to SEQ ID NO: 7
  misc_feature: RpS4

SEQ ID NO: 293 - DNA, 3024 bp, Phyllotreta atra; identical to SEQ ID NO: 218
  misc_feature: Rpn2

SEQ ID NO: 294 - DNA, 3024 bp, Phyllotreta atra; identical to SEQ ID NO: 218
  misc_feature: Rpn2

SEQ ID NO: 295 - DNA, 3024 bp, Phyllotreta atra; identical to SEQ ID NO: 218
  misc_feature: Rpn2

SEQ ID NO: 296 - DNA, 3024 bp, Phyllotreta atra; identical to SEQ ID NO: 218
  misc_feature: Rpn2

SEQ ID NO: 297 - DNA, 573 bp, Phyllotreta cruciferae
  misc_feature: ProsAlpha2
agacatttgttgataacttgcaagtaatcatttgtgaaaatgtcatctgaacgttatagtttttctttaacaactttcagcccttcaggtaaactagtccaaatcgaatatgctttagcggcagtggcggctggtgctccttcagtaggaataaaagcatcaaatggagtggtaatagccacagaaaacaagcacaaatccattctttacgacgaacacagcgtccataaagtagaaatgatcacgaagcacatcggaatggtctattccgggatgggacctgactaccgtttgttggtcaagcaagcacgtaaaatggcccaacagtattacctggtttacaaagaaccaattcctactgttcagctagttcaacgtgttgcaactgtaatgcaggaatacactcaatccgggggagttagacccttcggagtgtccctattgatctgcggatgggacaacaacaggccttacttattccagtgcgatccttctggggcgtatttcgcttggaaagccaccgcaatgggaaagaattatgtcaacgggaagacgttcctcgagaaaaggtaa

SEQ ID NO: 298 - DNA, 1001 bp, Phyllotreta cruciferae
  misc_feature: ProsBeta5
atttagccgatttgatttttgtttattcatcgtgcattaaataccaatagtaatttctgtatttaataataaaaattcaagtttaaatcatgagtttagaagcgttatcgggcattacaagctacaattccgaggattacgagcgactcgcctacgacgagagtctgcagaagtattgcaccaatttcaatggcatgaacttggccgttccgccttttcctgatcccagcaataactttgcaagattcaccaaagatgataatggccgtgagatcaaaattaagttcgaccacggtaccaccacattgggattcatgtacaaggggggcgtagtactcgcagtggattcccgagccactggaggccaattcattggatcacaaactgtagaaaaaatcataaaaatcaacagttttttgctagctacaatggcaggaggcgcggctgattgtacgtactgggaccgagtattagctaaacaatgtaggctgtacgaactgagaaacagggaacgtatttcggtggctgcggcttccaagttaatggccaatatggtttataattacaaaggaatgggtttgtccatgggaatgatgttggctggatgggacaaaaggggtcctcaactctactacgtcgattcagaaggtctaaggacagccgggaaagtgttcagcgtaggttcaggttccatttacgctttcggggtgcttgattctggatacaaatgggacttatccgatgaggaagcttatgatttaggtcgtagatcgatttaccacgctactcatagagacgcctattcaggaggtattgttagagtgtaccacatgaaagagactggttgggtgcacatcgatgataatgattgcatggacttgcattacaagtttgtggaggaaaaggagaaaatgggtggcgcttgattaaattaatttgtgaatttatattttttaagaataataaatttcttgcattaatttgtatactttttaataaat

SEQ ID NO: 299 - DNA, 699 bp, Phyllotreta cruciferae
  misc_feature: RpL19
taaaaacgcagccatatttctttttcggatacacgttgttacgagcgtgtgaaaaatgagttcgttaaaactccagaagaggctcgcagcctctgttatgagatgcggcaaaaagaaggtatggttggatcctaacgaaatcaacgaaatcgccaatacaaattcaagacaaaacatccgcaagctgattaaagatggtttgatcatcaagaagcctgtagcagtgcactcacgtgcccgtgtccgcaagaacaccgaagcccgcaggaagggtaggcactgcggttttggtaaaaggaaaggtacagcgaacgctcgaacaccaagaaaagaattatggattcaacgtatgagagtccttcgtcgtttgttgaaaaagtaccgtgaggccaagaaaatcgacagacatctgtaccattcgctgtacatgaaggcaaagggtaacgtattcaagaacaagcgtgtcctgatggaatacatccacaagaagaaggctgagaaggctcgcgccaagatgttggccgaccaggcgaacgccaagagaatgaaggtcaaacgcgccagggaaagacgtgaagaacgtatcgctacgaagaagcaggaagttttgcagaattaccagagggaagacgaagctgccgctgctactaaaaaataggttattcttcttcatttgatcactaataaaaagttaaggta

SEQ ID NO: 300 - DNA, 1334 bp, Phyllotreta cruciferae
  misc_feature: RpL3
cgtcaacatgtcgcacaggaagtttagtgcaccccgtcatggatccatgggattctaccccaagaaaagatcccaaaggcaccgtggaaaagtaaaggctttccccaaggatgatccctcgaaacccgttcatttaacagctttcattggctacaaagccggtatgacccacgtgctacgtgaggcagacaggcctggttcgaaaatcaacaagaaggaaatcgtagaggctgtaaccattttggaaactcctccgatgattgtagtaggtgttgtgggttacatcgaaactccgcatggtatgagagctttggccaccgtttgggctgaacatttgtccgaagattgccgtagacgtttctacaagaactggtacaagagcaagaagaaggctttcaccaaggcgtccaagaaatggaccgatgatttgggtaagaagtccattgagcgcgacttgaagaaaatcgtcaaatactgcaaggttgtcagagtcatcgctcacactcagatgaaattgttgaaacaacgtcaaaagaaagcccatattatggaaattcaactcaacggaggtaccattgccgacaaagtcgcatgggctaaggagcatttggagaagcccattcccgttggcaacgttttcgctcaagatgagatgatcgattgcatcggtgtaaccaaaggtcatggatacaaaggtgttacatctcgttggcatacgaagaaattgccccgcaagacgcacaagggtcttaggaaagtcgcctgtattggagcctggcatccttctcgagtgtcattcactgtcgctcgtgctggtcaaaagggttaccatcacaggacggagatgaacaagaaaatctacagaatcggtgctggaattcacactaaggacggaaaggtcatcaaaaacaatgctgctaccgattacgatcttagtgagaagaccattacaccaatgggtggtttccctcattatggtgaagttaacaatgacttcgtcatgattaagggttgttgtatgggacctaagaagcgtgtcattacactgagaaaatctctcttggttcacactaagcgtattgctttggagaagatcaatttgaaattcatcgatacgtcgtccaaattcggacacggtagattccaaaccgccgccgacaaggctgcgtttatgggacctcttaagaaagatagagttaaggaagaagacaagactgcggccccagctgcagctgctgcttcgagttaatttttatgcaatgtattttattgttgacaatatacattgattcagagtatttatttttgttatatttttatttattgttacccag

SEQ ID NO: 301 - DNA, 353 bp, Phyllotreta cruciferae
  misc_feature: RpL40
caactggaagatggaagaaccttgtctgactacaacattcagaaagagtccacattgcacttagttcttcgtctccgtggtgggatgcaaatattcgttaaaacccttactggtaaaactatcaccctcgaagttgaaccatctgatactattgagaacgtgaaggcgaaaatccaagacaaagagggtattcctccagatcagcaacgtttaattttcgctggcaaacaactggaagatggaagaaccttatctgactacaatattcaaaaagaatctactctacatttagtacttcgtctccgtggagggatgtaaatattcgttaaaactctttaataactaaaacagtg

SEQ ID NO: 302 - DNA, 374 bp, Phyllotreta cruciferae
  misc_feature: RpS21
gcaccctttcttttttgacgttcatccattttcttgtgtgttattttataacaatcatataaaacatggaaaacgacgctggtgaaaccgtcgacttgtactgcccaagaaaatgctctgctagcaacagaattattcatgctaaggaccacgctagcattcaactcagcgtcgccgacgttgatcctttaaccggaagaatgaccgaaagttccaagagctacgctctctgcggagctatcaggcgtatgggagaatcggacgattgtattgtgaggttaacgaagaaagatggaatcctagccaaaaacttctaattcactacttcgttaaagcattcagaaaatgtaatttaaacttttctaataaataaa

SEQ ID NO: 303 - DNA, 872 bp, Phyllotreta cruciferae
  misc_feature: RpS4
tttttttaacacttttcgcaagttttattgaaaataatattaacacatgtttagtgtgtttttgcagctagccttttatccctttcttcggcaatggatagcttcacacctttacctcttggaagagacacaaaagccttagctcctttaccaattacgaatacattatttaacctagtagcaaaggcatgaccgttagcatccttaatatgtacaatatcgaaggatccaggatgacgttccctgttcatgatcgtaccgacacgacccaaatttctacctccggtgatcatacacaagttgttggattcaaacttgatgtaatcgagaattttagacgtagcgatctccaattgaattgtgtcgtttaccttgatgacaggatcagggtaacggattgtacgaccatcgtgggtcaccaaaaacggaattcctttgggaccggtttgaaccctcttaactttgcaaagcttgtatttagcttcttcagcagtaatacggtggatagcaaatcttcctttcacatcatagatgagacggaaaaattcaccagttttttcaatggtgataacatccataaaacctgcggggtagttggagtcggtcctgacttttccatcgactttgattaatctttgcataactattttagttacctcgctgttagtgagagcatacttcagcctgtttcttaagaaaatcaccaagggtaatgattctcggagtttgtgaggaccggtggacgggcggggtgcgaatacacctcccaatttgtccaacatccatgctttcggcgcatttaaacgcttcaagtgctttttaggtccccgagccatcttgactttaaaaatatgaaagacagagcaggcgtg

SEQ ID NO: 304 - DNA, 1166 bp, Phyllotreta cruciferae
  misc_feature: Rpn2
cgtgcgttacggggccgccatggcgctgggcatagcctgcgccggcacgggcctccgcgaggccatagccctgctcgagcccatggtcatgttcgatccggtgaacttcgtccggcagggggctctcatcgcctcagcgatgatcctcatccagcagaccgagcagacctgcccgaaggtcagcttcttcaggcagacctactcccaggtcatctccaacaagcacgaagacgtcatggcgaagttcggcgccattttggcgcaaggtataatcgatgccggtggcaggaacgtgactttatcgctgcaatccagaaccggccacactaacatgctggccgttgtcggtacattggtgttcacgcagtattggtattggttccctctgtcgcattgtctggctttagcttttaccccgacgtgcgttatagcgttgaatactcaactgaagatgcctaaattggagttcaaatcgaacgcgaaaccgagcttgtacgcctacccggcgcccatggaggaaaagaaacgcgaggaaagggagaaagtcaccaccgccgtattgagcatagctgcgaggcaaaggagaagggatcacgagaggaaacatcgcgatgagaaaatggatgtggacgaagataaagacgataagaaaaccgaaaaggaggagaaagagaagaaaaccgaagacaagaaagaggagaaaaagtccgatgataagaaaaccgacgataaaaaagcggcgtcgtcgagcgacgacaaaaaagataagaaagatgataaggaggagaagaaaaaggagcccgagcctagtttcgaaatcttgcaaaatcctgccaggaccatgaggcaacaactgaaagtgattacgcttaatgataactcgcaatacgttgcaatgaaggatgtttctatcggagggattatcatggttcgcaatttgaaacctggcgaagaagaattggtggaacctgtagcagcattcggtccaaagggcgatgatgaaaaggaaccagaaccaccagaaccattcgaatggaccgaggattagagaaattcactagttatttctaaaatctaaatattaaacttggtttttttcattcagcttaagatgttttttttacatacagtgttgaattatttattcatatatttcttgtatgctg

SEQ ID NO: 305 - DNA, 635 bp, Phyllotreta cruciferae
  misc_feature: Rpt6
ctcggcaaacttatttccataattttttaatcgacatattcttctctgaatccttctgcatgaccttggccacagccatttcgaaatcttcttgggttacgtgtacccttctctcccttagggcgtacatgcctgcctcagtacacactcccttcacttcggcaccgctggcacctggcatcaattcggcgattttcctcaaattgatccctctggtcaaattcatttttctcgagtgaattttcaagatgtccaatcgggcttcctcgttcggtggagggaactcgatcttcctgtcaattctgccgggcctgagtaaagcgggatccaaaatgtcgattctgtttgtagccattataactttaatgttcttcgtagcctcaaatccatcgagttgattcagcaactccagcatagttctttgaacttcggaatcgccaccagaacctgattcgatacgagaggatccaatagaatcgatttcatccatgaaaatgatcgaaggggcatgctccctagccattacgaacagttcccttaccatcctagaaccttccccaatgaatttttgcaccaactccgatcctgatactctaataaacgtgcattctgtgtggtgagctacagctctagcc

SEQ ID NO: 306 - DNA, 467 bp, Phyllotreta cruciferae
  misc_feature: sec23
ggccgttgaaactgtaactgtacaaaattggttgaatcatgatcaatgattgagtaagatcttctctcatcaacatatgtctatagaacgacgtttcatcaggagaattattgaaaacttgcaagaactgagacctccttagatggtacatgaattgcggatagaggctaaagttttggcctaatctgaatgaaccagcatcgtctttattgtattctccgaatttttgacacaatcgaatcagcattctatcgacccatctcagaacgtcgggactctcatctgattcagctctataaacagccattctggccataattacagctgctgcttcctgatcaaaaccagcgctgatgtggtggatattagtagtggcatcagcccagtttcgagccactgttgtcactctaattcttctttgaccacttgagtgttgatactgagtaatgaattgtatgcaacctctt

SEQ ID NO: 307 - DNA, 1164 bp, Phyllotreta cruciferae
  misc_feature: shrb
agtacttttaaagctaatcgaattattttttgaacatcacctaagtgcaattacaaaatacattaaatctgtacaaaaagaagttatatattcatttagctaaatgttattaattatttaattaattgtcctgcctaataagtatgtgaatattaaatcctctttattagttcgtaaatcagatataccacattaatatgaaataacaaattaaacaaatactttttgtacagtttattgatacataatcaaatatttataattggagattaaagtatatctgatttgcacttatattacaaaaatagacagtaaatcataattattttaaagttaataaaaaaaatcaaaagagatactttcaggtattcgaaatacgagaaatattcattgtaactctaaacctttaagccaaaaaataagctgttaatagctatgtttttttttttcatttcacttgtgttattaatccatgcgagttcctcttatgaagcccaagcttccaattctttcatgtcatcatcatcctccacttttttagcagcaggtttaacgggcttggcaatagctcctgtaggtacagcaggtagttcagttgggcctggaactttcagcaaatcttcctctaatccttcttgttcgagcttttctagttcgctttctaattcatcctcgtccaaatcatcagcgaagcctaccggctggctaatagcagtagtaatctcgttggcaatgtcatgctgttcagctatgtcatccatgatgtcgtggacatcatcgacattcaagtttttgtgggctttttggagagcttcagctgcattcttcattgaatctaagacggctgtgttggtgctggctccttcgagggcctccctttgcatttcgattgtagtgagtgtgccatcgatttgtaattgagttttttccaatcgttttttctttttgagcgcctgcagcgcgactctcttattctttgatgcattttttttggctactagtgtatattcctctattttcttttctaaaaactcttgttttttatataacatgtcctcggtttccctgagcttttggatggcttcgcctggcgtggggcccacatccttttcttttcctccgaatattttactaaagaaactcattgttcaaatcaaaatgatg

SEQ ID NO: 308 - DNA, 348 bp, Phyllotreta cruciferae
  misc_feature: Vps16A
agggaaatcagtccacgagacctgcaggatcctgttggacatgaaggagaccaagttggccgagaagttcaagaacgacttcaaaattcccgataaaaggtattggtggttgaaaatcaacagcctggccgatcagaacgattggatcgagctggaaaagttttccaaagcgaagaagtcccctatcggatacgctcccttcgtggacgtttgcttgaggcaggacaaacggcaggaggccctcaaatatctgcccaaagtcggcgacgacatcaaagtcaaatactgcatcaaagccgggtgcttggaagaggccgccgacatagcttatcatcaaagggacgtgcg

SEQ ID NO: 309 - DNA, 1043 bp, Phyllotreta cruciferae
  misc_feature: VATP-E
cttattttgacagatcatatgatcgccagtgggagctcccattttgaacgagtttatcctgcaggagaagtgttgggcgtagttcagtcgagaagactctcgtttttcgtttaacaaatacccgaaatcgcatccacgatggctctgagcgacgcagatgtccagaaacagatcaagcacatgatggctttcatcgagcaagaggccaacgagaaggccgaagaaatcgatgccaaagccgaggaggagttcaacatagaaaagggccgtttggtccaacagcagcgcctcaagatcatggaatactacgagaagaaggagaaacaagtcgagctccagaagaaaatccaatcgtccaacatgctgaaccaggccagattgaaggtgttgaaagtgagagaagaccacgtgagggccgtgctagaagacgcccgcaagcgcctcggcgaagtcacccgagaccagggaaagtacggccacatcatcgaaagcctcatccttcaaggactctaccagctgttcgagaaagaagtaacggtcagggtgcgcccgcaggacagggagctggtcaagtcgattctgggcaacgtgcaaaccaagtacaaggacatcacgggcaaagaggtgcacttgaagatcgacgatgagtcgcacttgtcgcaggagaccaccggagggatcgatttgctggcgctgaagaataaagtgaagatcaacaacacgctcgaggcgcgattggatttgatttcgcagcaattggtgccccaaatacgtaacgctttgttcgggcgtaacgtgaacaggaagttcaccgattaggcggtttggtataacatttacatcggtcgaaataaaatagtattcgaaaatgatgtttataggtttattgtattgttatcatcaattgatgtgtaggattaattcgttgctctatattgtatcattccttgtatattttaatattttgtgaaaattgccggttttgttttaatgttttaattgagaaaatattaagaggcgattgtaatacatgtacataggcg

SEQ ID NO: 310 - DNA, 1841 bp, Phyllotreta cruciferae
  misc_feature: VATP-A
gttgcactacacttatctgttctaacaattaactgcgattaataagatacaatacacgatattttattttattaattcacgatatactgtacaagtttttgataaaatagaagtgaacgtacctttttacaacagattgtaaataaaaacgacgaggatgataccaggagggttacacaatcaaaaaaaataactaatactgaatataaatgactttagacacctgttaaaaaaatatgaaaaaaaaaaggaaaaacttaataataataaattggaatgacaggaataattttctttaaatattttataagcactgtaccctcaccaataaaaaactatacaatattcaacaatttacataaaatattttacatatttggtaatatcaaccgtctttgctactaaaaatggctcatcaattaaatgaataaatcgagggacaggtgacttacttttaacttaattatttattgtatttgatattatctctatcttttttttttcatttaaaacttacactgctgaaaaattttaagagaaatcctaacacctgcgacgaattaatcctccagatttctgaacgcctgctggatatcctcgtacaactgatcgaaatccgccttgatcttcgcctcgccatctttcaccggatccttgaacttcatactgctcaattggtacaaaatgttgctcatcgaatccctgatcaccgtccacgtgatcttgttctcagattgagcagtcgactccacggcgtgtctcgccatatcgtacatcccaatcatgttcttcaacatacccacggttttgtagaagggacagaatctatcgtacgatgagtacgagttctgttgcaggaaatcttctttcaacagcttggcgatttccaatgtaatcttatcagcttcagctaatgaagcttttcctaccagctgcacgatttccgtaaggtcgtcttcttcttgaaggatttctttaactttggttcttagcggtataaattcagggaagtttttgtcatagaaatcatccaaagccctcaaatatttagagtatgaactcagccagtcgacagacgggaagtgcttacgttgggcaagcttcttgtccaatccccaaaacacttgaacgataccaagagtagcggaagtgacaggatcagagaaatcaccaccaggcggcgacacggctcctacgatcgaaacagacccttccctatcggggttacccaagcacttaacgcgaccggcgcgctcgtagaaagaggccaatcgggcccccaagtaggccgggtaaccggaatcggcgggcatctcggccaaacgaccggaaatttctctcaacgcctcggcccaacgggacgtggaatcggccatcatcgatacgtggtaacccatgtctctgaagtactcggatagcgtgatacccgtatagatggaggcctcacgggcggccacgggcatgttggaggtgttggccaccagtgcggtacgcttcatgatggattcggtgtggccgtcgatttccacgctcagctcggggaagtcccgcaacacttcggacatttcgttgcctctctcgccgcaacccacgtagatgatgacgtcggagttggagtatttggacagcgattgggagatgacggttttgccgcaaccgaaggcgccgggaatggctgtcgtaccgccttgtacgcaagggaaaagagaatccaatacacgttgaccggtaagcagagggtgattggccggtaatttctcgctgaccggtctggcttgacggactggccatacttgtaacatggtgaatttggatcgttcaccatcgaattctgtctcaag

SEQ ID NO: 311 - DNA, 738 bp, Phyllotreta cruciferae
  misc_feature: COP I beta
gcccaaactcaaagccataccctgacttttggcccgaattctaatgtgaccggcgacgggcgcgtccggcttgttgaacggcttctcgatgctcaaattcgccagggcgtcctccccgaagatcgatttcgcgtacatattggccgccatgaagccgcattgcccgccgagcgccttctctgatgtcaggcacttcatgttagtactcttcagcagatgctccaggtactcgttgagatccgtcagcggcgtattgacggtcaccttattctcccattcgaattcagcccacatcctcataaactccgaatcggtgcacgatgccggaacaatgtaatccataatatcgatgtgtatgtcgttcaaaacgactacattcctgtccgaagcggcgcctgtcacgtcgtacacgatgttaccgaatatgataccattctcggtcgaggccactttcacgttagccttgatattgcagaaatccttcggcgccagaacgaccggctgaggcttctccaccaacttcaaatcgcccagagtcgccaactccagagtacaattctgcagcgtgtcgctcgtttggttcaccaccaacacgtccagcacgatatcgtactgattaacgtgcacatacgcttcggagtaaacaggatccgagaaacccgtcaactgggcgatcttgttcaatttactcgagccgatggtggagtccgattgccccgtcttgccgcccattagggc

SEQ ID NO: 312 - DNA, 1530 bp, Phyllotreta cruciferae
  misc_feature: Act5C
attgtgtgtatatatatatatattgtataaactatgccaaaaatttattaaaaaaaatgttacaatagttattatataatataacataaaatcatattctcgtttcgttttgtcttaaaaattagaaataaaagaggcaggtttttttacttagataggctttatttcaacctgcccggttacaaattaaaatatatttatatataacaaataaggtgttaaaatgatcttgaaatgtctgtctggcagtaaaacaaccacggtcgcataattgatgtaaaatacagtacaaacaacatgatatagtatatataatataggtaagagtagtaaatagcttagaagcacttgcggtgaacgattccagggccggattcgtcgtattcctgtttggagatccacatctgttggaaagtggaaagagaagccaagatggatccaccgatccatacggagtatttcctttctgggggagcaatgatcttgatcttgattgtgctgggggcaagagcggtgatttccttttgcatacggtcagcaataccagggtacatggtggtaccaccggagagtacagtgttggcgtacaagtccttacggatgtcgacgtcgcacttcatgatggagttgtatacggtttcgtggataccgcaggattccatacccaagaaggaaggttggaagagagcctcagggcaacggaatctttcgttaccgatggtgatgacttgaccgtcgggaagttcgtagctcttttcgagggaggtggaggcggcggcggtggccatttcctgttcgaagtcgagggcgacatagcagagtttctccttgatgtcgcggacgatttccctttcagcggtggtggtgaacgagtaacccctttcggtgaggattttcatgaggtagtcggtcaaatcgcgaccggccaagtccaaacggaggatggcgtggggaagagcgtaaccttcgtagatcggtacggtgtgggttacaccgtcaccggagtccaatacaataccggtggtacgaccggaagcgtagagggagagtacggcttggatggcgacgtacatggccggtgtgttgaaggtttcaaacatgatttgggtcatcttttccctgttggctttagggttaagaggagcctcggtcaagaggacggggtgttcttccggagcgacacggagttcgttgtagaaggtgtggtgccagatcttttccatgtcatcccagttggtgatgataccgtgttcgatggggtatttcaaagtgaggatacctcttttgctttgggcctcgtctcctacgtaggagtccttttgtcccataccgaccatcacaccctgatgtcttgggcgaccgacgatcgaggggaagacggcgcgcggggcgtcgtctccggcgaaaccagccttgcacataccggatccattgtcaacgacaagagccgcaacatcgtcgtcacacatgttgtcttctgtggttgatcactgctcactagacagatataaaacacagctaataagcttg

SEQ ID NO: 313 - DNA, 573 bp, Phyllotreta cruciferae; identical to SEQ ID NO: 297
  misc_feature: ProsAlpha2

SEQ ID NO: 314 - DNA, 1001 bp, Phyllotreta cruciferae; identical to SEQ ID NO: 298
  misc_feature: ProsBeta5

SEQ ID NO: 315 - DNA, 699 bp, Phyllotreta cruciferae; identical to SEQ ID NO: 299
  misc_feature: RpL19

SEQ ID NO: 316 - DNA, 1334 bp, Phyllotreta cruciferae; identical to SEQ ID NO: 300
  misc_feature: RpL3

SEQ ID NO: 317 - DNA, 353 bp, Phyllotreta cruciferae; identical to SEQ ID NO: 301
  misc_feature: RpL40

SEQ ID NO: 318 - DNA, 872 bp, Phyllotreta cruciferae; identical to SEQ ID NO: 303
  misc_feature: RpS4

SEQ ID NO: 319 - DNA, 1166 bp, Phyllotreta cruciferae; identical to SEQ ID NO: 304
  misc_feature: Rpn2

SEQ ID NO: 320 - DNA, 635 bp, Phyllotreta cruciferae; identical to SEQ ID NO: 305
  misc_feature: Rpt6

SEQ ID NO: 321 - DNA, 467 bp, Phyllotreta cruciferae; identical to SEQ ID NO: 306
  misc_feature: sec23

SEQ ID NO: 322 - DNA, 1164 bp, Phyllotreta cruciferae; identical to SEQ ID NO: 307
  misc_feature: shrb

SEQ ID NO: 323 - DNA, 1043 bp, Phyllotreta cruciferae; identical to SEQ ID NO: 309
  misc_feature: VATP-E

SEQ ID NO: 324 - DNA, 1841 bp, Phyllotreta cruciferae; identical to SEQ ID NO: 310
  misc_feature: VATP-A

SEQ ID NO: 325 - DNA, 738 bp, Phyllotreta cruciferae; identical to SEQ ID NO: 311
  misc_feature: COPI beta

SEQ ID NO: 326 - DNA, 1530 bp, Phyllotreta cruciferae; identical to SEQ ID NO: 312
  misc_feature: Act5C

SEQ ID NO: 327 - DNA, 333 bp, Phyllotreta cruciferae
  misc_feature: COPI alpha
aacatgttcttcaagctcaaaaactacaaaactgctgcttctttcgccaagaggctgttagaactcggtcctaggcctgaagtagcccagcaagcgaggaaaatattgcaggcttgcgattcgaatcttacagatgatttgcaattgcagtatgacgagcacaatcctttcaacttgtgtgggcactcttatacacctatttataggggaaaggctgaagagaaatgtccattatgcggtacttcttatttacctaaatataaaggggtattgtgtaatatttgcaaagtggcggaagttggaaaggatacgattggattgaggattagcacg

SEQ ID NO: 328 - DNA, 414 bp, Phyllotreta cruciferae
  misc_feature: COPI delta
acgcacggagtgcagcttcaaacgcacccgaatgtcgataaagaactgttcaaattgcgttcagaaattggtttaaaacagccttcgaaaccattcccgctccacactgacgtaggtgtattaaaatggcgattgcaaagtactgacgaagccctggtgcctctgctaataaactgttggccttctgaagcaggagacggcagttgcgatgtgaatattgaatacgaacttgcccacactaacttagaattagtggacgttaacattacaattcctttgccaattggttgctctccaatagtgggtgaatgcgatggttcgtacactcacgaagcaaaaagaaatcatcttgtatggaacctgccggtaattgatgctagcaacaagacgggttctttagaattcaacgcgccc

SEQ ID NO: 329 - DNA, 414 bp, Phyllotreta cruciferae; identical to SEQ ID NO: 328
  misc_feature: COPI delta

SEQ ID NO: 330 - DNA, 414 bp, Phyllotreta cruciferae; identical to SEQ ID NO: 328
  misc_feature: COPI delta

SEQ ID NO: 331 - DNA, 414 bp, Phyllotreta cruciferae; identical to SEQ ID NO: 328
  misc_feature: COPI delta

SEQ ID NO: 332 - DNA, 423 bp, Phyllotreta cruciferae
  misc_feature: COPI epsilon
gccactgtttacgttaacgaaggcaacttggaagccgcttacaaagtgcttcatgcttcggaaaatctggaagcttacgctttcatcatcgatatattattgaagttagatcgggtagatttggctaagaagaagctcaaggaaatgcaggataaagatgatgatgccacgttaacacagctagcgcaagcttgggttaatgttgccattggaggtgataaattgcaagatgcttactacatttatcaagaaatggttgataaatatggctcgacgcctcttctgttgaatgggcaagcagttgcttttataggacaggctaaatatgaggaagctgaagctgctttgcaggaagctatagataaagatgctaattatccggacacactggttaatttgattacacttcaaaggcatatgggg

SEQ ID NO: 333 - DNA, 423 bp, Phyllotreta cruciferae; identical to SEQ ID NO: 332
  misc_feature: COPI epsilon

SEQ ID NO: 334 - DNA, 771 bp, Phyllotreta cruciferae
  misc_feature: COPI gamma
gtctcccgcgaggagaacttcgcggagaaactgtcggccataccgggcatccagcagctgggcccgatcttcaagagctccgaggtggtggagctgaccgaatccgagacggagtacttcgtgcgctgcatcaagcattgcttcgcccaccacgtggtcctgcagttcgattgcctgaacacgctggccgatcaattgctggaggacgtgcgggtggagctggagccgagcgaagggttcgagttgctgtcggtggtgccgtgcaagcagctgcattacaacgagaccaatcacacctacgctattttgaagttccccgacgacgatttgcctagttgcgttggtactttcggggcggtgttgaagtttatcgttaaagattgcgatcccaccactggcattcccgatagcgatgaaggttacaatgatgaatacatactcgaagacttggaaataacgttgggcgatcaaatacagagagtgagcaaggtcaattggggcgccgcttgggaatcggctgctgagggttccgtggaaaaggaggatacgtattctctcagttcgatgaatacgttggatgaagctgtgaaaaatatcgtgcagttccttggattgcaaccggccgaaagaactgataaagtgcccgaaggcaagagcacccacacgcttctactatcaggagtctttagaggaggaatcgatattttggtaagagctaaacttgctttagcggatggtgttacaatgcaactgactgtaagatcacccgat

SEQ ID NO: 335 - DNA, 772 bp, Phyllotreta cruciferae
  misc_feature: COPI gamma
gtctcccgcgaggagaacttcgcggagaaactgtcggccataccgggcatccagcagctgggcccgatcttcaagagctccgaggtggtggagctgaccgaatccgagacggagtacttcgtgcgctgcatcaagcattgcttcgcccaccacgtggtcctgcagttcgattgcctgaacacgctggccgatcaattgctggaggacgtgcgggtggagctggagccgagcgaagggttcgagttgctgtcggtggtgccgtgcaagcagctgcattacaacgagaccaatcacacctacgctattttgaagttccccgacgacgatttgcctagttgcgttggtactttcggggcggtgttgaagtttatcgttaaagattgcgatcccaccactggcattcccgatagcgatgaaggttacaatgatgaatacatactcgaagacttggaaataacgttgggcgatcaaatacagagagtgagcaaggtcaattggggcgccgcttgggaatcggctgctgagggttccgtggaaaaggaggatacgtattctctcagttcgatgaatacgttggatgaagctgtgaaaaatatcgtgcagttccttggattgcaaccggccgaaagaactgataaagtgcccgaaggcaagagcacccacacgcttctactatcaggagtctttagaggaggaatcgatattttggtaagagctaaacttgctttagcggatggtgttacaatgcaactgactgtaagatcacccgatg

SEQ ID NO: 336 - DNA, 772 bp, Phyllotreta cruciferae; identical to SEQ ID NO: 335
  misc_feature: COPI gamma

SEQ ID NO: 337 - DNA, 772 bp, Phyllotreta cruciferae; identical to SEQ ID NO: 335
  misc_feature: COPI gamma

SEQ ID NO: 338 - DNA, 772 bp, Phyllotreta cruciferae; identical to SEQ ID NO: 335
  misc_feature: COPI gamma

SEQ ID NO: 339 - DNA, 772 bp, Phyllotreta cruciferae; identical to SEQ ID NO: 335
  misc_feature: COPI gamma

SEQ ID NO: 340 - DNA, 772 bp, Phyllotreta cruciferae; identical to SEQ ID NO: 335
  misc_feature: COPI gamma

SEQ ID NO: 341 - DNA, 772 bp, Phyllotreta cruciferae; identical to SEQ ID NO: 335
  misc_feature: COPI gamma

SEQ ID NO: 342 - DNA, 772 bp, Phyllotreta cruciferae; identical to SEQ ID NO: 335
  misc_feature: COPI gamma

SEQ ID NO: 343 - DNA, 772 bp, Phyllotreta cruciferae; identical to SEQ ID NO: 335
  misc_feature: COPI gamma

SEQ ID NO: 344 - DNA, 772 bp, Phyllotreta cruciferae; identical to SEQ ID NO: 335
  misc_feature: COPI gamma

SEQ ID NO: 345 - DNA, 546 bp, Phyllotreta cruciferae
  misc_feature: COPI zeta
aattcactaatggaaggctcgttattggaacccactttgaacgccattaaaggcatagctatattggataatgatggaaaccgaatattggcaaagtattacgacaaaaacgtatttcccacagcgaaagagcagaagactttcgagaaaaacctgttcaacaaaacccacagggcgaacgcggaaattataatgcttgatggccttacatgtgtgtacaaaagtaacgtagatttatttttctatgttatgggtagttctcatgaaaatgagttaattctaatgagcgttttaaattgcttatacgattccgtgagtcaaattctaaggaagaatatggaaaagagggtagttttagattcattagatatagtcatgttggccatggatgaaatctgtgatggagggattatcatcgatgccgattccaactcggtcatatcgagagttgctttaagaaacgacgacattccgattggggagcaaacagtcgcccaggtgtttcaatcagccaaagaacagctgaaatggtcattattaaagtaa

SEQ ID NO: 346 - DNA, 546 bp, Phyllotreta cruciferae; identical to SEQ ID NO: 345
  misc_feature: COPI zeta

SEQ ID NO: 347 - DNA, 546 bp, Phyllotreta cruciferae; identical to SEQ ID NO: 345
  misc_feature: COPI zeta

SEQ ID NO: 348 - DNA, 546 bp, Phyllotreta cruciferae; identical to SEQ ID NO: 345
  misc_feature: COPI zeta

SEQ ID NO: 349 - DNA, 546 bp, Phyllotreta cruciferae; identical to SEQ ID NO: 345
  misc_feature: COPI zeta

SEQ ID NO: 350 - DNA, 546 bp, Phyllotreta cruciferae; identical to SEQ ID NO: 345
  misc_feature: COPI zeta

SEQ ID NO: 351 - DNA, 792 bp, Phyllotreta cruciferae
  misc_feature: RpL07
ctcgcaagttctttttctgtcataccgtcaaatatggcaccgacagccgagaagaaaacgaaaacagtgaagggattgcccgcggtccccgagtctgtgctgaagcaccgcaaaaggcgcgaggcttccagagctaagaggctccaatctatcgtgaagagaaaatccgagcacatcaagaagaggaaagatattttcaagagggccgaacaatacattaaagagtacaggctgaaggaacgagatgaaattaggttgatccgccaagctaaaaacaagggaaacttctacgttccagcggaagctaaattagctttcgtaatgcgtattaagggtatcaacaaggttgccccgaaagttcgcaaagtcctccaactgttcaggctgctccaaatcaacaacggagtgttcgtccagctcaacaaggctaccatcaacatgcttagaatatgcgaaccttacattacctggggttaccccaacttgaaatcggtcagggagctgatctacaagagaggtttcgctaaagtgaacggacagagagtgcccattacgagcaatcaaatcatcgaagacagattaggcaaatctggaattatttgcatggaagatttgattcatgaaatttttactgttggacctaagtttaagtacgcctctaacttcttgtggccgtttaagctaaacacacctactggtgggtggcgcaagaagaccaatcactacgttgaaggtggtgactttggtaatagagaagataaaattaacgaacttctcagaagaatggtgtaa

SEQ ID NO: 352 - DNA, 792 bp, Phyllotreta cruciferae; identical to SEQ ID NO: 351
  misc_feature: RpL07

SEQ ID NO: 353 - DNA, 792 bp, Phyllotreta cruciferae; identical to SEQ ID NO: 351
  misc_feature: RpL07

SEQ ID NO: 354 - DNA, 792 bp, Phyllotreta cruciferae; identical to SEQ ID NO: 351
  misc_feature: RpL07

SEQ ID NO: 355 - DNA, 792 bp, Phyllotreta cruciferae; identical to SEQ ID NO: 351
  misc_feature: RpL07

SEQ ID NO: 356 - DNA, 792 bp, Phyllotreta cruciferae; identical to SEQ ID NO: 351
  misc_feature: RpL07

SEQ ID NO: 357 - DNA, 792 bp, Phyllotreta cruciferae; identical to SEQ ID NO: 351
  misc_feature: RpL07

SEQ ID NO: 358 - DNA, 792 bp, Phyllotreta cruciferae; identical to SEQ ID NO: 351
  misc_feature: RpL07

SEQ ID NO: 359 - DNA, 792 bp, Phyllotreta cruciferae; identical to SEQ ID NO: 351
  misc_feature: RpL07

SEQ ID NO: 360 - DNA, 489 bp, Phyllotreta cruciferae
  misc_feature: Rpn3
caacggttcggggaggtgttggagaattttgggccgcaatttagggtagatcatacgtttactttgatcctgcggcttcggcataatgttatcaagacagctattagatcgattggtttgtcttattccaggatatctccgcaggatatagctaagaaattgggcctggattcagcggaggatgcggaattcatcgtagcgaaggccattcgagatggtgttatcgaagctactttggacccacaagggggctacatgaggagtaaagagagtactgatatctactgtactaaagagcctcaattggcctttcatcagaggatatcattttgtttggatttgcacaatcagagcgtgaaagccatgagatacccgccgaatgcgtacggaaaggaactggaatcggctgaggaaagacgggagagggagcagcaggatttggaattggccaaggaaatggctgaagatgatgatgatagttttccttaa

SEQ ID NO: 361 - DNA, 489 bp, Phyllotreta cruciferae; identical to SEQ ID NO: 360
  misc_feature: Rpn3

SEQ ID NO: 362 - DNA, 489 bp, Phyllotreta cruciferae; identical to SEQ ID NO: 360
  misc_feature: Rpn3

SEQ ID NO: 363 - DNA, 489 bp, Phyllotreta cruciferae; identical to SEQ ID NO: 360
  misc_feature: Rpn3

SEQ ID NO: 364 - DNA, 489 bp, Phyllotreta cruciferae; identical to SEQ ID NO: 360
  misc_feature: Rpn3

SEQ ID NO: 365 - DNA, 672 bp, Phyllotreta cruciferae
  misc_feature: Rpn8
attaattcgaagatactgccccaattcagtcttggtgattatagatgcgaaacctaaagatctggggcttcctactgaagcataccaagcggtagaagaggtccatgatgatggctctcctacatctaaaacgtttgaacacgtcccgagcgaaataggcgcagaagaagctgaggaagtcggagtagaacatttactaagagatattaaagacactacagtgggaactttatctcaaaggattactaatcagttattaggccttaaagggttgcatttgcaattgagagatataagagactatttgatgcaagtgtgcgataacaaactgcccatcaatcatcagatcatctatcaattgcaggatattttcaatttgttgcccgatataaatcaagatgcgttcaacaattcgttttatgttaaaaataacgatcaaatgcttgtagtttatttaggggctctcgttcgatctatcgttgcattgcacaacctaatcaacaacaaactcaccaacagagacgcagaagaaggcaaaaaggaagagaaaaaggacaacaaggataaagatagcaaagacaaggataaggaaaaaacggacaaagagaaggaagcgaagaaggacgagaagaaaaaataagtgttttattttctttttgtaactattttcgt

SEQ ID NO: 366 - DNA, 672 bp, Phyllotreta cruciferae; identical to SEQ ID NO: 365
  misc_feature: Rpn8

SEQ ID NO: 367 - DNA, 672 bp, Phyllotreta cruciferae; identical to SEQ ID NO: 365
  misc_feature: Rpn8

SEQ ID NO: 368 - DNA, 672 bp, Phyllotreta cruciferae; identical to SEQ ID NO: 365
  misc_feature: Rpn8

SEQ ID NO: 369 - DNA, 672 bp, Phyllotreta cruciferae; identical to SEQ ID NO: 365
  misc_feature: Rpn8

SEQ ID NO: 370 - DNA, 672 bp, Phyllotreta cruciferae; identical to SEQ ID NO: 365
  misc_feature: Rpn8

SEQ ID NO: 371 - DNA, 672 bp, Phyllotreta cruciferae; identical to SEQ ID NO: 365
  misc_feature: Rpn8

SEQ ID NO: 372 - DNA, 672 bp, Phyllotreta cruciferae; identical to SEQ ID NO: 365
  misc_feature: Rpn8

SEQ ID NO: 373 - DNA, 672 bp, Phyllotreta cruciferae; identical to SEQ ID NO: 365
  misc_feature: Rpn8

SEQ ID NO: 374 - DNA, 672 bp, Phyllotreta cruciferae; identical to SEQ ID NO: 365
  misc_feature: Rpn8

SEQ ID NO: 375 - DNA, 597 bp, Phyllotreta cruciferae
  misc_feature: Rpn9
cagaaaatggctgcagctgcggtgcaaccgtctaatgttagtgattatcttgctaaacaacaaaaagaaagtccgaaggaattgggctctgagtgggcagaacttgaggagctccataataaaaaattatggcatcaactaaccctcaaattactagtgtttataaagaaaccagaattacagaaagcggacaacctaatccagctgtaccacaattttattcaaacgtttgaaaataaaattaatcctttgtctttggtcgaaatagcggccattgtcgtcgaacagtacaaggaaccgaaagacgcgatcgctttcctagaaaagactgaacccaaagtaaaaatcaacccggatgcccaaaacttgtgcaaagtcctcgaaggacagatctaccttgataagttaaacgatttagacaccaccaaaaagatcatcgaggaggtcgaagcgacctttgataatgcggacggggttactccagtacacgggagattttatttactcgcctcgcaatattacagaattcaaggagaccatgcgcaatattatcgcactgctttgaggtatttgggctgcatagatgtggaatcgttg

SEQ ID NO: 376 - DNA, 597 bp, Phyllotreta cruciferae; identical to SEQ ID NO: 375
  misc_feature: Rpn9

SEQ ID NO: 377 - DNA, 597 bp, Phyllotreta cruciferae; identical to SEQ ID NO: 375
  misc_feature: Rpn9

SEQ ID NO: 378 - DNA, 597 bp, Phyllotreta cruciferae; identical to SEQ ID NO: 375
  misc_feature: Rpn9

SEQ ID NO: 379 - DNA, 597 bp, Phyllotreta cruciferae; identical to SEQ ID NO: 375
  misc_feature: Rpn9

SEQ ID NO: 380 - DNA, 597 bp, Phyllotreta cruciferae; identical to SEQ ID NO: 375
  misc_feature: Rpn9

SEQ ID NO: 381 - DNA, 597 bp, Phyllotreta cruciferae; identical to SEQ ID NO: 375
  misc_feature: Rpn9

SEQ ID NO: 382 - DNA, 597 bp, Phyllotreta cruciferae; identical to SEQ ID NO: 375
  misc_feature: Rpn9

SEQ ID NO: 383 - DNA, 597 bp, Phyllotreta cruciferae; identical to SEQ ID NO: 375
  misc_feature: Rpn9

SEQ ID NO: 384 - DNA, 588 bp, Phyllotreta cruciferae
  misc_feature: Sar1
accgaaatgttcatatgggattggttcacgggagtgctgggctacctaggattatggaagaagtccgggaaattgctgtttttagggctggataacgctggtaaaaccaccttattacacatgcttaaagacgatagattagcccagcacttgcccacgttacatcccacttctgaagaactgtccatcgggaacatgaggtttaccacgttcgatctaggaggccattcgcaggctcgaagagtatggaaggactacttcccagccgtagacgccattgtattccttatcgacgctaacgatagatctcgattcggagaaagcaaacgggagctcgacgcgctgttgacagacgaaaccctggccaactgccccgtgctgattctaggcaataaaatcgatttacccgacgcggcgtctgaggatgagttgagaaacgtttactcgttgtacggccaaacgaccggtaaaggtaaagtcgctcgatcggatctgccggggagaccgttggagctgtttatgtgctcgattctgaagaggcagggctacggggagggttttcgttggctggcgcagtacattgattag

SEQ ID NO: 385 - DNA, 588 bp, Phyllotreta cruciferae; identical to SEQ ID NO: 384
  misc_feature: Sar1

SEQ ID NO: 386 - DNA, 588 bp, Phyllotreta cruciferae; identical to SEQ ID NO: 384
  misc_feature: Sar1

SEQ ID NO: 387 - DNA, 588 bp, Phyllotreta cruciferae; identical to SEQ ID NO: 384
  misc_feature: Sar1

SEQ ID NO: 388 - DNA, 588 bp, Phyllotreta cruciferae; identical to SEQ ID NO: 384
  misc_feature: Sar1

SEQ ID NO: 389 - DNA, 588 bp, Phyllotreta cruciferae; identical to SEQ ID NO: 384
  misc_feature: Sar1

SEQ ID NO: 390 - DNA, 1521 bp, Phyllotreta cruciferae
  misc_feature: VATPase B
gttagacgtatctttcttcacgcagagaagatgtcttacccatcgacgttaaacgcaaaacaggccgcacaggaacacgttttagccgtgtccagagacttcgtatcccagccaaggctcacttacaaaacagtgtctggtgtcaacggaccgttggtaatcctcgaagatgtcaaatttccgaaattcaacgaaatcgtccagctcaaactggccgatggcagtctacgatccggtcaagtattggaggtgagcggctcgaaagccgtagtacaagtgttcgaaggtacttcgggaatcgacgccaaaaacaccgtgtgtgaattcaccggcgacattctcagaacgcccgtgtccgaagacatgttgggcagggtgttcaacggctcaggaaaaccaatcgataaaggacccccaattttggctgaggacttcttggacatccaaggtcaaccgatcaatccttggtcgcgtatctacccggaggaaatgatccaaaccggtatctccgccatcgatgtgatgaactcgatcgctcgtggtcagaagattcccattttctcggcggctggtctgccccacaacgaaatcgccgcccaaatttgtagacaagccggtcttgtcaaggtgcccggcaagtcggctttggacgatcacgaagacaacttcgccatcgtgttcgccgctatgggagtcaacatggaaactgctcgtttcttcaaacaagatttcgaagagaacggttcgatggagaacgtttgtttgttcttgaatttggcgaacgatcctactattgagagaatcatcacgcctcgtttggctctaacagcagccgaatttttggcctatcaatgcgagaaacacgtcttggtcatattgactgatatgtcttcgtacgctgaagctttgcgtgaggtatccgccgccagggaagaagtgcccggtagacgtggtttccccggttacatgtacaccgatttggccaccatttacgaacgagccggacgtgtggagggccgcaacggctccatcacccaaatccccatcttgactatgcccaacgacgatattactcacccgattcccgatttgaccggttatattaccgaaggacagatctacgtcgaccgtcagctgcacaacaggcaaatttaccccccgattaacgtcttaccatcactgtctcgtctcatgaagtccgccatcggcgagggaatgaccaggaaagatcactctgacgtttctaaccagttgtacgcttgctacgccattggtaaggacgttcaggcgatgaaggccgtggtgggagaggaggccctgacgcccgacgatttgctctacctggagttcctgaccaagttcgagaagaacttcatctcgcagggcagctacgagaatcgtacagtgttcgaatcgctggacatcggctggcagttgttgcgtatcttccccaaggaaatgttgaaacgtatcccggccgccacgttggccgaattctacccgagggactcgcgtcattag

SEQ ID NO: 391 - DNA, 2281 bp, Phyllotreta cruciferae
  misc_feature: VATPase B
gttagacgtatctttcttcacgcagagaagatgtcttacccatcgacgttaaacgcaaaacaggccgcacaggaacacgttttagccgtgtccagagacttcgtatcccagccaaggctcacttacaaaacagtgtctggtgtcaacggaccgttggtaatcctcgaagatgtcaaatttccgaaattcaacgaaatcgtccagctcaaactggccgatggcagtctacgatccggtcaagtattggaggtgagcggctcgaaagccgtagtacaagtgttcgaaggtacttcgggaatcgacgccaaaaacaccgtgtgtgaattcaccggcgacattctcagaacgcccgtgtccgaagacatgttgggcagggtgttcaacggctcaggaaaaccaatcgataaaggacccccaattttggctgaggacttcttggacatccaaggtcaaccgatcaatccttggtcgcgtatctacccggaggaaatgatccaaaccggtatctccgccatcgatgtgatgaactcgatcgctcgtggtcagaagattcccattttctcggcggctggtctgccccacaacgaaatcgccgcccaaatttgtagacaagccggtcttgtcaaggtgcccggcaagtcggctttggacgatcacgaagacaacttcgccatcgtgttcgccgctatgggagtcaacatggaaactgctcgtttcttcaaacaagatttcgaagagaacggttcgatggagaacgtttgtttgttcttgaatttggcgaacgatcctactattgagagaatcatcacgcctcgtttggctctaacagcagccgaatttttggcctatcaatgcgagaaacacgtcttggtcatattgactgatatgtcttcgtacgctgaagctttgcgtgaggtatccgccgccagggaagaagtgcccggtagacgtggtttccccggttacatgtacaccgatttggccaccatttacgaacgagccggacgtgtggagggccgcaacggctccatcacccaaatccccatcttgactatgcccaacgacgatattactcacccgattcccgatttgaccggttatattaccgaaggacagatctacgtcgaccgtcagctgcacaacaggcaaatttaccccccgattaacgtcttaccatcactgtctcgtctcatgaagtccgccatcggcgagggaatgaccaggaaagatcactctgacgtttctaaccagttgtacgcttgctacgccattggtaaggacgttcaggcgatgaaggccgtggtgggagaggaggccctgacgcccgacgatttgctctacctggagttcctgaccaagttcgagaagaacttcatctcgcagggcagctacgagaatcgtacagtgttcgaatcgctggacatcggctggcagttgttgcgtatcttccccaaggaaatgttgaaacgtatcccggccgccacgttggccgaattctacccgagggactcgcgtcattagtttcattgttatgtaaaaaaaagaaactttgtatattaatagggagtttgtaaggtttacgaaatgttttatttggaaggtggttttttcgtttgcgaatttattctggcgaacaggcaactatgtggcttttaaatctaaaaactgatttatgtagtgaaagtacttgatttctgaacgaaaaaattatcttctgatattttttgtaaattattaggaaacgcccttccatagggaaagtttattaggtttgttaatgaagtccacttgtaccgattagttgattttaccaaataattttaagccgatgatattgcggtgtaatttttttttgtaaatattatacggcgcctttgagaaaggcgttcaatgtatattaatgcaagttgtcaccctcattttgccgtttgattttatttctattagaaagaatggattatgcaaaaaaaagataaaatgattttaattgtaaaagcaaaatgggttggttacaccatgtgaattaatttcctaatttcaagagtttaaaaagtaccctttccatttatttagatgaaaataagacaatactatttttatcatataagttgatatttaatttttcattgattactctgcacaattgttattacgttcatggtcctgttaaagtggaaattttacattccatatttaaatgtcattgcccttgtataaaagcaatacaaaaagcattgtagcatttcgaagcttttcagtatttttaatctagatggtgaac

SEQ ID NO: 392 - DNA, 2281 bp, Phyllotreta cruciferae; identical to SEQ ID NO: 391
  misc_feature: VATPase B

SEQ ID NO: 393 - DNA, 2281 bp, Phyllotreta cruciferae; identical to SEQ ID NO: 391
  misc_feature: VATPase B

SEQ ID NO: 394 - DNA, 2281 bp, Phyllotreta cruciferae; identical to SEQ ID NO: 391
  misc_feature: VATPase B

SEQ ID NO: 395 - DNA, 2281 bp, Phyllotreta cruciferae; identical to SEQ ID NO: 391
  misc_feature: VATPase B

SEQ ID NO: 396 - DNA, 2281 bp, Phyllotreta cruciferae; identical to SEQ ID NO: 391
  misc_feature: VATPase B

SEQ ID NO: 397 - DNA, 2281 bp, Phyllotreta cruciferae; identical to SEQ ID NO: 391
  misc_feature: VATPase B

SEQ ID NO: 398 - DNA, 2281 bp, Phyllotreta cruciferae; identical to SEQ ID NO: 391
  misc_feature: VATPase B

SEQ ID NO: 399 - DNA, 387 bp, Phyllotreta cruciferae
  misc_feature: Vps2
ttaaaaatggagtggctgttcggtaaaaaagtcacccccgaagaattgcttcgaaaaaatcaaagagcgctaaacaaagccatgcgagatctagacagggaaaaacaaaaaatggaacaacaagagaagaaggttataaacgacattaaaaaattagccaaagaaggtcaaatggacgccgtcaagatcatggccaaggacttggtcaggaccagacgatacgtaaagaaattcatgctaatgaaagccaacatccaagcagtctcgctaaaaatccaaacgctcagatcgcagaacgccatggcgcaagccatgaaaggtgtcaccaaagccatgcagagcatgaacaggcagctcaatttaccccaaatacaacgaatcctgcat

SEQ ID NO: 400 - DNA, 630 bp, Phyllotreta cruciferae
  misc_feature: Vps24
ttggttacagagtggaaccacaaactgcgcaaagaaggctaccaactggaaaggcaaatacgatccatacagcgagaggaagaaaaagtcaagcgatccctaaaggaagcagccaagaaaaacgacaaggacacctgcctaatactcgccaaagaaatcataaactctcgcaaagccatcaacaagatctacacgtccaaagcccacctcaattccgtaatgttgcaaatgaaaaaccaattagccactctcagggtgtcgggctcgctgcaaaaatccacggaggtcatgcagaccatgcagaggctcgtacgggtgccggaggtggcgcagacgatgcaagacatgtccaaagagatgatgaaagccggtatcatcgaggagatgctggacgagaccatggaggatctcgaggactctgaggagatggaggaagcggcgcaaactgagatagataaagtgctattcgagataacggaagggaagattggggaggctccaatgccgccgcaggagcccgccgagaaggtgtctccggtgccggcgacgtcggtggaggagcccgaggaggaggagaacgaagaggagatttcggagatgcaaagtcgcttggctgcgctcaaatcgtaa

SEQ ID NO: 401 - DNA, 630 bp, Phyllotreta cruciferae; identical to SEQ ID NO: 400
  misc_feature: Vps24

SEQ ID NO: 402 - DNA, 630 bp, Phyllotreta cruciferae; identical to SEQ ID NO: 400
  misc_feature: Vps24

SEQ ID NO: 403 - DNA, 630 bp, Phyllotreta cruciferae; identical to SEQ ID NO: 400
  misc_feature: Vps24

SEQ ID NO: 404 - DNA, 630 bp, Phyllotreta cruciferae; identical to SEQ ID NO: 400
  misc_feature: Vps24

SEQ ID NO: 405 - DNA, 630 bp, Phyllotreta cruciferae; identical to SEQ ID NO: 400
  misc_feature: Vps24

SEQ ID NO: 406 - DNA, 630 bp, Phyllotreta cruciferae; identical to SEQ ID NO: 400
  misc_feature: Vps24

SEQ ID NO: 407 - DNA, 453 bp, Phyllotreta cruciferae
  misc_feature: Vps28
tttataatgtctgctaatcacgaaaatcgtccagagctttacgaagaagtaaaactatatcacaatgcaagggaaagggaaaaatacgataatttagcagatctctacgcagttatcaacacattgcaacagcttgaaaaggcgtacattagggattgtgttgttgccaaagaatatactggtgcttgtagtaagctactagttcaatacaaagcagcattcagacaagttaatggagatgagtttcctactgttgatgcttttgttaagaaatataggcttgattgcccggctgccctagaaagaattaaagaagacagacctattactattaaagatgataagggaaatactagtagatgtattgctgatattgtgtccctattcattactgtaatggacaaattgagattagatattcgttccatggatcagttacatcctgatgtgaga

SEQ ID NO: 408 - DNA, 453 bp, Phyllotreta cruciferae; identical to SEQ ID NO: 407
  misc_feature: Vps28

SEQ ID NO: 409 - DNA, 453 bp, Phyllotreta cruciferae; identical to SEQ ID NO: 407
  misc_feature: Vps28

SEQ ID NO: 410 - DNA, 453 bp, Phyllotreta cruciferae; identical to SEQ ID NO: 407
  misc_feature: Vps28

SEQ ID NO: 411 - DNA, 453 bp, Phyllotreta cruciferae; identical to SEQ ID NO: 407
  misc_feature: Vps28

SEQ ID NO: 412 - DNA, 453 bp, Phyllotreta cruciferae; identical to SEQ ID NO: 407
  misc_feature: Vps28

SEQ ID NO: 413 - DNA, 717 bp, Phyllotreta cruciferae
  misc_feature: Vps4
aaatggctgggtgaatccgagaagctggtgaagaatctgttcgaattggcccgagcgcacaagcccagcatcatcttcatcgatgagatcgattcgctctgttcttcacgttccgataacgaatctgagtctgctagaaggatcaaaaccgagtttttggtccaaatgcaaggtgtgggtcacgacaccgaagggattctggtactaggagcaacgaatataccgtgggtattagattctgcgattcgaagacgtttcgaaaagagaatttacataccgctgccggaggagccggccagggctgtaatgtttaaactgcatttgggtaataccagaacggaattgaccgaagaggacattaaagaattagccagcaagacagaagggtattcgggtgcagatataagtatagttgttcgagatgctctcatgcagcctgtacgtaaagtgcaaacagccacgcattttaagaaagttaggggaccttctccgactgatccaaaaacgattgttgacgatttgttgataccgtgttcgccaggtgatcctggtgctatagaaatgtcctggatggatataccgagtgataagttagccgagccgcccgttactctgaatgatatgttaagatctgtgtccacctcgaaaccaacagtcaatgatgaggatctgaccaaattgagaaagttcatggaggatttcgggcaagaaggataa

SEQ ID NO: 414 - DNA, 717 bp, Phyllotreta cruciferae; identical to SEQ ID NO: 413
  misc_feature: Vps4

SEQ ID NO: 415 - DNA, 717 bp, Phyllotreta cruciferae; identical to SEQ ID NO: 413
  misc_feature: Vps4

SEQ ID NO: 416 - DNA, 717 bp, Phyllotreta cruciferae; identical to SEQ ID NO: 413
  misc_feature: Vps4

SEQ ID NO: 417 - DNA, 717 bp, Phyllotreta cruciferae; identical to SEQ ID NO: 413
  misc_feature: Vps4

SEQ ID NO: 418 - DNA, 717 bp, Phyllotreta cruciferae; identical to SEQ ID NO: 413
  misc_feature: Vps4

SEQ ID NO: 419 - DNA, 717 bp, Phyllotreta cruciferae; identical to SEQ ID NO: 413
  misc_feature: Vps4

SEQ ID NO: 420 - DNA, 717 bp, Phyllotreta cruciferae; identical to SEQ ID NO: 413
  misc_feature: Vps4

SEQ ID NO: 421 - DNA, 717 bp, Phyllotreta cruciferae; identical to SEQ ID NO: 413
  misc_feature: Vps4

SEQ ID NO: 422 - DNA, 717 bp, Phyllotreta cruciferae; identical to SEQ ID NO: 413
  misc_feature: Vps4

SEQ ID NO: 423 - DNA, 717 bp, Phyllotreta cruciferae; identical to SEQ ID NO: 413
  misc_feature: Vps4

SEQ ID NO: 424 - DNA, 663 bp, Phyllotreta cruciferae
  misc_feature: snf7
acaatgagtttctttagtaaaatattcggaggaaaagaaaaggatgtgggccccacgccaggcgaagccatccaaaagctcagggaaaccgaggacatgttatataaaaaacaagagtttttagaaaagaaaatagaggaatatacactagtagccaaaaaaaatgcatcaaagaataagagagtcgcgctgcaggcgctcaaaaagaaaaaacgattggaaaaaactcaattacaaatcgatggcacactcactacaatcgaaatgcaaagggaggccctcgaaggagccagcaccaacacagccgtcttagattcaatgaagaatgcagctgaagctctccaaaaagcccacaaaaacttgaatgtcgatgatgtccacgacatcatggatgacatagctgaacagcatgacattgccaacgagattactactgctattagccagccggtaggcttcgctgatgatttggacgaggatgaattagaaagcgaactagaaaagctcgaacaagaaggattagaggaagatttgctgaaagttccaggcccaactgaactacctgctgtacctacaggagctattgccaagcccgttaaacctgctgctaaaaaagtggaggatgatgatgacatgaaagaattggaagcttgggcttcataa

SEQ ID NO: 425 - DNA, 663 bp, Phyllotreta cruciferae; identical to SEQ ID NO: 424
  misc_feature: snf7

SEQ ID NO: 426 - DNA, 663 bp, Phyllotreta cruciferae; identical to SEQ ID NO: 424
  misc_feature: snf7

SEQ ID NO: 427 - DNA, 663 bp, Phyllotreta cruciferae; identical to SEQ ID NO: 424
  misc_feature: snf7

SEQ ID NO: 428 - DNA, 663 bp, Phyllotreta cruciferae; identical to SEQ ID NO: 424
  misc_feature: snf7

SEQ ID NO: 429 - DNA, 663 bp, Phyllotreta cruciferae; identical to SEQ ID NO: 424
  misc_feature: snf7

SEQ ID NO: 430 - DNA, 663 bp, Phyllotreta cruciferae; identical to SEQ ID NO: 424
  misc_feature: snf7

SEQ ID NO: 431 - DNA, 663 bp, Phyllotreta cruciferae; identical to SEQ ID NO: 424
  misc_feature: snf7

SEQ ID NO: 432 - DNA, 663 bp, Phyllotreta cruciferae; identical to SEQ ID NO: 424
  misc_feature: snf7

SEQ ID NO: 433 - DNA, 663 bp, Phyllotreta cruciferae; identical to SEQ ID NO: 424
  misc_feature: snf7

SEQ ID NO: 434 - DNA, 663 bp, Phyllotreta cruciferae; identical to SEQ ID NO: 424
  misc_feature: snf7

SEQ ID NO: 435 - DNA, 1065 bp, Phyllotreta cruciferae
  misc_feature: Vatpase D
aagtttcgattttcgatcatgaaggggtgtctttttaacatcgacaacggttacttggaaggtctatgccgcggcttcaaatgcggcatattgaagcaagccgattacctcaatttagtgcaatgcgaaactctggaagatttgaagctgcatttacaaggcacagactacggcacgttcctggccaacgaaccctccccattgtcagtatccaccatcgacgacaaattgagggaaaaactcgtcatcgagttccagcatatgcgtaaccaagccgtagaacccctgtccacattcctggacttcatcacctacagttacatgatcgataacataattcttttaatcaccggaactttgcatcaaagacccattggtgagttgattccaaaatgccaccccctcggcagcttcgagcaaatggaagccatccacgtagcagccactccagcggaattgtacaacgcggtgttagtagacactccgctagctcctttcttcgtcgattgcatcagcgagcaagatttggacgagatgaacatcgaaatcatcaggaacactctgtacaaagcctacttggaggctttcttcaccttctgcaaggaaatcggaggcaccactgctgacagcatgtgcgaaatcctggctttcgaagccgatagacgtgctataatcatcactatcaactccttcggaacggaattgagcaaagatgaccgcgctaagttgtacccgcgttgcggaaaactccagcctgatggtttggccgctctagctagagctgaggattacgagcaggtcaaagctgtggccgagtattatgctgagtactccaaattgttcgagggggctggaaacaatccgggagataagacgttggaggacaaattcttcgagcatgaagtgcgcctgaacatcaacgcgttcatgcaacagttccacttcggtgtgttctattcctatttgaagctgaaggagcaggaatgcaggaacatcgtttggatcgcagagtgcgtggctcagaagcacagggccaagatcgataactacattccgatattctag

SEQ ID NO: 436 - DNA, 1065 bp, Phyllotreta cruciferae; identical to SEQ ID NO: 435
  misc_feature: Vatpase D

SEQ ID NO: 437 - DNA, 1065 bp, Phyllotreta cruciferae; identical to SEQ ID NO: 435
  misc_feature: Vatpase D

SEQ ID NO: 438 - DNA, 1065 bp, Phyllotreta cruciferae; identical to SEQ ID NO: 435
  misc_feature: Vatpase D

SEQ ID NO: 439 - DNA, 1065 bp, Phyllotreta cruciferae; identical to SEQ ID NO: 435
  misc_feature: Vatpase D

SEQ ID NO: 440 - DNA, 606 bp, Phyllotreta cruciferae
  misc_feature: RpL19
aaaatgagttcgttaaaactccagaagaggctcgcagcctctgttatgagatgcggcaaaaagaaggtatggttggatcctaacgaaatcaacgaaatcgccaatacaaattcaagacaaaacatccgcaagctgattaaagatggtttgatcatcaagaagcctgtagcagtgcactcacgtgcccgtgtccgcaagaacaccgaagcccgcaggaagggtaggcactgcggttttggtaaaaggaaaggtacagcgaacgctcgaacaccaagaaaagaattatggattcaacgtatgagagtccttcgtcgtttgttgaaaaagtaccgtgaggccaagaaaatcgacagacatctgtaccattcgctgtacatgaaggcaaagggtaacgtattcaagaacaagcgtgtcctgatggaatacatccacaagaagaaggctgagaaggctcgcgccaagatgttggccgaccaggcgaacgccaagagaatgaaggtcaaacgcgccagggaaagacgtgaagaacgtatcgctacgaagaagcaggaagttttgcagaattaccagagggaagacgaagctgccgctgctactaaaaaatag

SEQ ID NO: 441 - DNA, 606 bp, Phyllotreta cruciferae; identical to SEQ ID NO: 440
  misc_feature: RpL19

SEQ ID NO: 442 - DNA, 606 bp, Phyllotreta cruciferae; identical to SEQ ID NO: 440
  misc_feature: RpL19

SEQ ID NO: 443 - DNA, 606 bp, Phyllotreta cruciferae; identical to SEQ ID NO: 440
  misc_feature: RpL19

SEQ ID NO: 444 - DNA, 606 bp, Phyllotreta cruciferae; identical to SEQ ID NO: 440
  misc_feature: RpL19

SEQ ID NO: 445 - DNA, 1248 bp, Phyllotreta cruciferae
  misc_feature: RpL3
gtcaacatgtcgcacaggaagtttagtgcaccccgtcatggatccatgggattctaccccaagaaaagatcccaaaggcaccgtggaaaagtaaaggctttccccaaggatgatccctcgaaacccgttcatttaacagctttcattggctacaaagccggtatgacccacgtgctacgtgaggcagacaggcctggttcgaaaatcaacaagaaggaaatcgtagaggctgtaaccattttggaaactcctccgatgattgtagtaggtgttgtgggttacatcgaaactccgcatggtatgagagctttggccaccgtttgggctgaacatttgtccgaagattgccgtagacgtttctacaagaactggtacaagagcaagaagaaggctttcaccaaggcgtccaagaaatggaccgatgatttgggtaagaagtccattgagcgcgacttgaagaaaatcgtcaaatactgcaaggttgtcagagtcatcgctcacactcagatgaaattgttgaaacaacgtcaaaagaaagcccatattatggaaattcaactcaacggaggtaccattgccgacaaagtcgcatgggctaaggagcatttggagaagcccattcccgttggcaacgttttcgctcaagatgagatgatcgattgcatcggtgtaaccaaaggtcatggatacaaaggtgttacatctcgttggcatacgaagaaattgccccgcaagacgcacaagggtcttaggaaagtcgcctgtattggagcctggcatccttctcgagtgtcattcactgtcgctcgtgctggtcaaaagggttaccatcacaggacggagatgaacaagaaaatctacagaatcggtgctggaattcacactaaggacggaaaggtcatcaaaaacaatgctgctaccgattacgatcttagtgagaagaccattacaccaatgggtggtttccctcattatggtgaagttaacaatgacttcgtcatgattaagggttgttgtatgggacctaagaagcgtgtcattacactgagaaaatctctcttggttcacactaagcgtattgctttggagaagatcaatttgaaattcatcgatacgtcgtccaaattcggacacggtagattccaaaccgccgccgacaaggctgcgtttatgggacctcttaagaaagatagagttaaggaagaagacaagactgcggccccagctgcagctgctgcttcgagttaa

SEQ ID NO: 446 - DNA, 1248 bp, Phyllotreta cruciferae; identical to SEQ ID NO: 445
  misc_feature: RpL3

SEQ ID NO: 447 - DNA, 1248 bp, Phyllotreta cruciferae; identical to SEQ ID NO: 445
  misc_feature: RpL3

SEQ ID NO: 448 - DNA, 1248 bp, Phyllotreta cruciferae; identical to SEQ ID NO: 445
  misc_feature: RpL3

SEQ ID NO: 449 - DNA, 1248 bp, Phyllotreta cruciferae; identical to SEQ ID NO: 445
  misc_feature: RpL3

SEQ ID NO: 450 - DNA, 546 bp, Phyllotreta cruciferae
  misc_feature: Proteasome alpha 2
tcatttgtgaaaatgtcatctgaacgttatagtttttctttaacaactttcagcccttcaggtaaactagtccaaatcgaatatgctttagcggcagtggcggctggtgctccttcagtaggaataaaagcatcaaatggagtggtaatagccacagaaaacaagcacaaatccattctttacgacgaacacagcgtccataaagtagaaatgatcacgaagcacatcggaatggtctattccgggatgggacctgactaccgtttgttggtcaagcaagcacgtaaaatggcccaacagtattacctggtttacaaagaaccaattcctactgttcagctagttcaacgtgttgcaactgtaatgcaggaatacactcaatccgggggagttagacccttcggagtgtccctattgatctgcggatgggacaacaacaggccttacttattccagtgcgatccttctggggcgtatttcgcttggaaagccaccgcaatgggaaagaattatgtcaacgggaagacgttcctcgagaaaaggtaa

SEQ ID NO: 451 - DNA, 546 bp, Phyllotreta cruciferae; identical to SEQ ID NO: 450
  misc_feature: Proteasome alpha 2

SEQ ID NO: 452 - DNA, 546 bp, Phyllotreta cruciferae; identical to SEQ ID NO: 450
  misc_feature: Proteasome alpha 2

SEQ ID NO: 453 - DNA, 546 bp, Phyllotreta cruciferae; identical to SEQ ID NO: 450
  misc_feature: Proteasome alpha 2

SEQ ID NO: 454 - DNA, 840 bp, Phyllotreta cruciferae
  misc_feature: Proteasome beta 5
atcatgagtttagaagcgttatcgggcattacaagctacaattccgaggattacgagcgactcgcctacgacgagagtctgcagaagtattgcaccaatttcaatggcatgaacttggccgttccgccttttcctgatcccagcaataactttgcaagattcaccaaagatgataatggccgtgagatcaaaattaagttcgaccacggtaccaccacattgggattcatgtacaaggggggcgtagtactcgcagtggattcccgagccactggaggccaattcattggatcacaaactgtagaaaaaatcataaaaatcaacagttttttgctagctacaatggcaggaggcgcggctgattgtacgtactgggaccgagtattagctaaacaatgtaggctgtacgaactgagaaacagggaacgtatttcggtggctgcggcttccaagttaatggccaatatggtttataattacaaaggaatgggtttgtccatgggaatgatgttggctggatgggacaaaaggggtcctcaactctactacgtcgattcagaaggtctaaggacagccgggaaagtgttcagcgtaggttcaggttccatttacgctttcggggtgcttgattctggatacaaatgggacttatccgatgaggaagcttatgatttaggtcgtagatcgatttaccacgctactcatagagacgcctattcaggaggtattgttagagtgtaccacatgaaagagactggttgggtgcacatcgatgataatgattgcatggacttgcattacaagtttgtggaggaaaaggagaaaatgggtggcgcttga

SEQ ID NO: 455 - DNA, 840 bp, Phyllotreta cruciferae; identical to SEQ ID NO: 454
  misc_feature: Proteasome beta 5

SEQ ID NO: 456 - DNA, 840 bp, Phyllotreta cruciferae; identical to SEQ ID NO: 454
  misc_feature: Proteasome beta 5

SEQ ID NO: 457 - DNA, 840 bp, Phyllotreta cruciferae; identical to SEQ ID NO: 454
  misc_feature: Proteasome beta 5

SEQ ID NO: 458 - DNA, 840 bp, Phyllotreta cruciferae; identical to SEQ ID NO: 454
  misc_feature: Proteasome beta 5

SEQ ID NO: 459 - DNA, 840 bp, Phyllotreta cruciferae; identical to SEQ ID NO: 454
  misc_feature: Proteasome beta 5

SEQ ID NO: 460 - DNA, 840 bp, Phyllotreta cruciferae; identical to SEQ ID NO: 454
  misc_feature: Proteasome beta 5

SEQ ID NO: 461 - DNA, 347 bp, Phyllotreta cruciferae
  misc_feature: Vps16A
gggaaatcagtccacgagacctgcaggatcctgttggacatgaaggagaccaagttggccgagaagttcaagaacgacttcaaaattcccgataaaaggtattggtggttgaaaatcaacagcctggccgatcagaacgattggatcgagctggaaaagttttccaaagcgaagaagtcccctatcggatacgctcccttcgtggacgtttgcttgaggcaggacaaacggcaggaggccctcaaatatctgcccaaagtcggcgacgacatcaaagtcaaatactgcatcaaagccgggtgcttggaagaggccgccgacatagcttatcatcaaagggacgtgcg

SEQ ID NO: 462 - DNA, 705 bp, Phyllotreta cruciferae
  misc_feature: VATP-E/Vha26
caaatacccgaaatcgcatccacgatggctctgagcgacgcagatgtccagaaacagatcaagcacatgatggctttcatcgagcaagaggccaacgagaaggccgaagaaatcgatgccaaagccgaggaggagttcaacatagaaaagggccgtttggtccaacagcagcgcctcaagatcatggaatactacgagaagaaggagaaacaagtcgagctccagaagaaaatccaatcgtccaacatgctgaaccaggccagattgaaggtgttgaaagtgagagaagaccacgtgagggccgtgctagaagacgcccgcaagcgcctcggcgaagtcacccgagaccagggaaagtacggccacatcatcgaaagcctcatccttcaaggactctaccagctgttcgagaaagaagtaacggtcagggtgcgcccgcaggacagggagctggtcaagtcgattctgggcaacgtgcaaaccaagtacaaggacatcacgggcaaagaggtgcacttgaagatcgacgatgagtcgcacttgtcgcaggagaccaccggagggatcgatttgctggcgctgaagaataaagtgaagatcaacaacacgctcgaggcgcgattggatttgatttcgcagcaattggtgccccaaatacgtaacgctttgttcgggcgtaacgtgaacaggaagttcaccgattag

SEQ ID NO: 463 - DNA, 705 bp, Phyllotreta cruciferae; identical to SEQ ID NO: 462
  misc_feature: VATP-E/Vha26

SEQ ID NO: 464 - DNA, 705 bp, Phyllotreta cruciferae; identical to SEQ ID NO: 462
  misc_feature: VATP-E/Vha26

SEQ ID NO: 465 - DNA, 705 bp, Phyllotreta cruciferae; identical to SEQ ID NO: 462
  misc_feature: VATP-E/Vha26

SEQ ID NO: 466 - DNA, 705 bp, Phyllotreta cruciferae; identical to SEQ ID NO: 462
  misc_feature: VATP-E/Vha26

SEQ ID NO: 467 - DNA, 705 bp, Phyllotreta cruciferae; identical to SEQ ID NO: 462
  misc_feature: VATP-E/Vha26

SEQ ID NO: 468 - DNA, 705 bp, Phyllotreta cruciferae; identical to SEQ ID NO: 462
  misc_feature: VATP-E/Vha26

SEQ ID NO: 469 - DNA, 1281 bp, Phyllotreta cruciferae
  misc_feature: VATP-A/Vha68-2
cttgagacagaattcgatggtgaacgatccaaattcaccatgttacaagtatggccagtccgtcaagccagaccggtcagcgagaaattaccggccaatcaccctctgcttaccggtcaacgtgtattggattctcttttcccttgcgtacaaggcggtacgacagccattcccggcgccttcggttgcggcaaaaccgtcatctcccaatcgctgtccaaatactccaactccgacgtcatcatctacgtgggttgcggcgagagaggcaacgaaatgtccgaagtgttgcgggacttccccgagctgagcgtggaaatcgacggccacaccgaatccatcatgaagcgtaccgcactggtggccaacacctccaacatgcccgtggccgcccgtgaggcctccatctatacgggtatcacgctatccgagtacttcagagacatgggttaccacgtatcgatgatggccgattccacgtcccgttgggccgaggcgttgagagaaatttccggtcgtttggccgagatgcccgccgattccggttacccggcctacttgggggcccgattggcctctttctacgagcgcgccggtcgcgttaagtgcttgggtaaccccgatagggaagggtctgtttcgatcgtaggagccgtgtcgccgcctggtggtgatttctctgatcctgtcacttccgctactcttggtatcgttcaagtgttttggggattggacaagaagcttgcccaacgtaagcacttcccgtctgtcgactggctgagttcatactctaaatatttgagggctttggatgatttctatgacaaaaacttccctgaatttataccgctaagaaccaaagttaaagaaatccttcaagaagaagacgaccttacggaaatcgtgcagctggtaggaaaagcttcattagctgaagctgataagattacattggaaatcgccaagctgttgaaagaagatttcctgcaacagaactcgtactcatcgtacgatagattctgtcccttctacaaaaccgtgggtatgttgaagaacatgattgggatgtacgatatggcgagacacgccgtggagtcgactgctcaatctgagaacaagatcacgtggacggtgatcagggattcgatgagcaacattttgtaccaattgagcagtatgaagttcaaggatccggtgaaagatggcgaggcgaagatcaaggcggatttcgatcagttgtacgaggatatccagcaggcgttcagaaatctggaggattaa

SEQ ID NO: 470 - DNA, 1281 bp, Phyllotreta cruciferae; identical to SEQ ID NO: 469
  misc_feature: VATP-A/Vha68-2

SEQ ID NO: 471 - DNA, 1281 bp, Phyllotreta cruciferae; identical to SEQ ID NO: 469
  misc_feature: VATP-A/Vha68-2

SEQ ID NO: 472 - DNA, 1281 bp, Phyllotreta cruciferae; identical to SEQ ID NO: 469
  misc_feature: VATP-A/Vha68-2

SEQ ID NO: 473 - DNA, 1281 bp, Phyllotreta cruciferae; identical to SEQ ID NO: 469
  misc_feature: VATP-A/Vha68-2

SEQ ID NO: 474 - DNA, 1281 bp, Phyllotreta cruciferae; identical to SEQ ID NO: 469
  misc_feature: VATP-A/Vha68-2

SEQ ID NO: 475 - DNA, 1281 bp, Phyllotreta cruciferae; identical to SEQ ID NO: 469
  misc_feature: VATP-A/Vha68-2

SEQ ID NO: 476 - DNA, 1281 bp, Phyllotreta cruciferae; identical to SEQ ID NO: 469
  misc_feature: VATP-A/Vha68-2

SEQ ID NO: 477 - DNA, 1281 bp, Phyllotreta cruciferae; identical to SEQ ID NO: 469
  misc_feature: VATP-A/Vha68-2

SEQ ID NO: 478 - DNA, 1281 bp, Phyllotreta cruciferae; identical to SEQ ID NO: 469
  misc_feature: VATP-A/Vha68-2

SEQ ID NO: 479 - DNA, 1281 bp, Phyllotreta cruciferae; identical to SEQ ID NO: 469
  misc_feature: VATP-A/Vha68-2

SEQ ID NO: 480 - DNA, 738 bp, Phyllotreta cruciferae
  misc_feature: Beta COPI
gccctaatgggcggcaagacggggcaatcggactccaccatcggctcgagtaaattgaacaagatcgcccagttgacgggtttctcggatcctgtttactccgaagcgtatgtgcacgttaatcagtacgatatcgtgctggacgtgttggtggtgaaccaaacgagcgacacgctgcagaattgtactctggagttggcgactctgggcgatttgaagttggtggagaagcctcagccggtcgttctggcgccgaaggatttctgcaatatcaaggctaacgtgaaagtggcctcgaccgagaatggtatcatattcggtaacatcgtgtacgacgtgacaggcgccgcttcggacaggaatgtagtcgttttgaacgacatacacatcgatattatggattacattgttccggcatcgtgcaccgattcggagtttatgaggatgtgggctgaattcgaatgggagaataaggtgaccgtcaatacgccgctgacggatctcaacgagtacctggagcatctgctgaagagtactaacatgaagtgcctgacatcagagaaggcgctcggcgggcaatgcggcttcatggcggccaatatgtacgcgaaatcgatcttcggggaggacgccctggcgaatttgagcatcgagaagccgttcaacaagccggacgcgcccgtcgccggtcacattagaattcgggccaaaagtcagggtatggctttgagtttgggc

SEQ ID NO: 481 - DNA, 738 bp, Phyllotreta cruciferae; identical to SEQ ID NO: 311
  misc_feature: Beta COPI

SEQ ID NO: 482 - DNA, 738 bp, Phyllotreta cruciferae; identical to SEQ ID NO: 311
  misc_feature: Beta COPI

SEQ ID NO: 483 - DNA, 738 bp, Phyllotreta cruciferae; identical to SEQ ID NO: 311
  misc_feature: Beta COPI

SEQ ID NO: 484 - DNA, 738 bp, Phyllotreta cruciferae; identical to SEQ ID NO: 311
  misc_feature: Beta COPI

SEQ ID NO: 485 - DNA, 1248 bp, Phyllotreta cruciferae; identical to SEQ ID NO: 445
  misc_feature: RpL3

SEQ ID NO: 486 - DNA, 1248 bp, Phyllotreta cruciferae; identical to SEQ ID NO: 445
  misc_feature: RpL3

SEQ ID NO: 487 - DNA, 1248 bp, Phyllotreta cruciferae; identical to SEQ ID NO: 445
  misc_feature: RpL3

SEQ ID NO: 488 - DNA, 1248 bp, Phyllotreta cruciferae; identical to SEQ ID NO: 445
  misc_feature: RpL3

SEQ ID NO: 489 - DNA, 353 bp, Phyllotreta cruciferae; identical to SEQ ID NO: 301
  misc_feature: RpL40

SEQ ID NO: 490 - DNA, 255 bp, Phyllotreta cruciferae
  misc_feature: RpS21
aacatggaaaacgacgctggtgaaaccgtcgacttgtactgcccaagaaaatgctctgctagcaacagaattattcatgctaaggaccacgctagcattcaactcagcgtcgccgacgttgatcctttaaccggaagaatgaccgaaagttccaagagctacgctctctgcggagctatcaggcgtatgggagaatcggacgattgtattgtgaggttaacgaagaaagatggaatcctagccaaaaacttctaa

SEQ ID NO: 491 - DNA, 822 bp, Phyllotreta cruciferae
  misc_feature: RpS4
cacgcctgctctgtctttcatatttttaaagtcaagatggctcggggacctaaaaagcacttgaagcgtttaaatgcgccgaaagcatggatgttggacaaattgggaggtgtattcgcaccccgcccgtccaccggtcctcacaaactccgagaatcattacccttggtgattttcttaagaaacaggctgaagtatgctctcactaacagcgaggtaactaaaatagttatgcaaagattaatcaaagtcgatggaaaagtcaggaccgactccaactaccccgcaggttttatggatgttatcaccattgaaaaaactggtgaatttttccgtctcatctatgatgtgaaaggaagatttgctatccaccgtattactgctgaagaagctaaatacaagctttgcaaagttaagagggttcaaaccggtcccaaaggaattccgtttttggtgacccacgatggtcgtacaatccgttaccctgatcctgtcatcaaggtaaacgacacaattcaattggagatcgctacgtctaaaattctcgattacatcaagtttgaatccaacaacttgtgtatgatcaccggaggtagaaatttgggtcgtgtcggtacgatcatgaacagggaacgtcatcctggatccttcgatattgtacatattaaggatgctaacggtcatgcctttgctactaggttaaataatgtattcgtaattggtaaaggagctaaggcttttgtgtctcttccaagaggtaaaggtgtgaagctatccattgccgaagaaagggataaaaggctagctgcaaaaacacactaa

SEQ ID NO: 492 - DNA, 822 bp, Phyllotreta cruciferae; identical to SEQ ID NO: 491
  misc_feature: RpS4

SEQ ID NO: 493 - DNA, 822 bp, Phyllotreta cruciferae; identical to SEQ ID NO: 491
  misc_feature: RpS4

SEQ ID NO: 494 - DNA, 822 bp, Phyllotreta cruciferae; identical to SEQ ID NO: 491
  misc_feature: RpS4

SEQ ID NO: 495 - DNA, 822 bp, Phyllotreta cruciferae; identical to SEQ ID NO: 491
  misc_feature: RpS4

SEQ ID NO: 496 - DNA, 822 bp, Phyllotreta cruciferae; identical to SEQ ID NO: 491
  misc_feature: RpS4

SEQ ID NO: 497 - DNA, 822 bp, Phyllotreta cruciferae; identical to SEQ ID NO: 491
  misc_feature: RpS4

SEQ ID NO: 498 - DNA, 1166 bp, Phyllotreta cruciferae; identical to SEQ ID NO: 304
  misc_feature: Rpn2

SEQ ID NO: 499 - DNA, 1166 bp, Phyllotreta cruciferae; identical to SEQ ID NO: 304
  misc_feature: Rpn2

SEQ ID NO: 500 - DNA, 1166 bp, Phyllotreta cruciferae; identical to SEQ ID NO: 304
  misc_feature: Rpn2

SEQ ID NO: 501 - DNA, 1166 bp, Phyllotreta cruciferae; identical to SEQ ID NO: 304
  misc_feature: Rpn2

SEQ ID NO: 502 - DNA, 1166 bp, Phyllotreta cruciferae; identical to SEQ ID NO: 304
  misc_feature: Rpn2

SEQ ID NO: 503 - DNA, 1166 bp, Phyllotreta cruciferae; identical to SEQ ID NO: 304
  misc_feature: Rpn2

SEQ ID NO: 504 - DNA, 1166 bp, Phyllotreta cruciferae; identical to SEQ ID NO: 304
  misc_feature: Rpn2

SEQ ID NO: 505 - DNA, 1166 bp, Phyllotreta cruciferae; identical to SEQ ID NO: 304
  misc_feature: Rpn2

SEQ ID NO: 506 - DNA, 1166 bp, Phyllotreta cruciferae; identical to SEQ ID NO: 304
  misc_feature: Rpn2

SEQ ID NO: 507 - DNA, 1166 bp, Phyllotreta cruciferae; identical to SEQ ID NO: 304
  misc_feature: Rpn2

SEQ ID NO: 508 - DNA, 1166 bp, Phyllotreta cruciferae; identical to SEQ ID NO: 304
  misc_feature: Rpn2

SEQ ID NO: 509 - DNA, 624 bp, Phyllotreta cruciferae
  misc_feature: Rpt6
gctagagctgtagctcaccacacagaatgcacgtttattagagtatcaggatcggagttggtgcaaaaattcattggggaaggttctaggatggtaagggaactgttcgtaatggctagggagcatgccccttcgatcattttcatggatgaaatcgattctattggatcctctcgtatcgaatcaggttctggtggcgattccgaagttcaaagaactatgctggagttgctgaatcaactcgatggatttgaggctacgaagaacattaaagttataatggctacaaacagaatcgacattttggatcccgctttactcaggcccggcagaattgacaggaagatcgagttccctccaccgaacgaggaagcccgattggacatcttgaaaattcactcgagaaaaatgaatttgaccagagggatcaatttgaggaaaatcgccgaattgatgccaggtgccagcggtgccgaagtgaagggagtgtgtactgaggcaggcatgtacgccctaagggagagaagggtacacgtaacccaagaagatttcgaaatggctgtggccaaggtcatgcagaaggattcagagaagaatatgtcgattaaaaaattatggaaataa

SEQ ID NO: 510 - DNA, 624 bp, Phyllotreta cruciferae; identical to SEQ ID NO: 509
  misc_feature: Rpt6

SEQ ID NO: 511 - DNA, 624 bp, Phyllotreta cruciferae; identical to SEQ ID NO: 509
  misc_feature: Rpt6

SEQ ID NO: 512 - DNA, 465 bp, Phyllotreta cruciferae
  misc_feature: sec23
agaggttgcatacaattcattactcagtatcaacactcaagtggtcaaagaagaattagagtgacaacagtggctcgaaactgggctgatgccactactaatatccaccacatcagcgctggttttgatcaggaagcagcagctgtaattatggccagaatggctgtttatagagctgaatcagatgagagtcccgacgttctgagatgggtcgatagaatgctgattcgattgtgtcaaaaattcggagaatacaataaagacgatgctggttcattcagattaggccaaaactttagcctctatccgcaattcatgtaccatctaaggaggtctcagttcttgcaagttttcaataattctcctgatgaaacgtcgttctatagacatatgttgatgagagaagatcttactcaatcattgatcatgattcaaccaattttgtacagttacagtttcaacggc

SEQ ID NO: 513 - DNA, 465 bp, Phyllotreta cruciferae; identical to SEQ ID NO: 512
  misc_feature: sec23

SEQ ID NO: 514 - DNA, 465 bp, Phyllotreta cruciferae; identical to SEQ ID NO: 512
  misc_feature: sec23

SEQ ID NO: 515 - DNA, 465 bp, Phyllotreta cruciferae; identical to SEQ ID NO: 512
  misc_feature: sec23

SEQ ID NO: 516 - DNA, 465 bp, Phyllotreta cruciferae; identical to SEQ ID NO: 512
  misc_feature: sec23

SEQ ID NO: 517 - DNA, 465 bp, Phyllotreta cruciferae; identical to SEQ ID NO: 512
  misc_feature: sec23

SEQ ID NO: 518 - DNA, 663 bp, Phyllotreta cruciferae; identical to SEQ ID NO: 424
  misc_feature: snf7/shrb

SEQ ID NO: 519 - DNA, 738 bp, Phyllotreta cruciferae; identical to SEQ ID NO: 311
  misc_feature: Beta COPI

SEQ ID NO: 520 - DNA, 738 bp, Phyllotreta cruciferae; identical to SEQ ID NO: 311
  misc_feature: Beta COPI

SEQ ID NO: 521 - DNA, 738 bp, Phyllotreta cruciferae; identical to SEQ ID NO: 311
  misc_feature: Beta COPI

SEQ ID NO: 522 - DNA, 738 bp, Phyllotreta cruciferae; identical to SEQ ID NO: 311
  misc_feature: Beta COPI

SEQ ID NO: 523 - DNA, 738 bp, Phyllotreta cruciferae; identical to SEQ ID NO: 311
  misc_feature: Beta COPI

SEQ ID NO: 524 - DNA, 738 bp, Phyllotreta cruciferae; identical to SEQ ID NO: 311
  misc_feature: Beta COPI

SEQ ID NO: 525 - DNA, 1167 bp, Phyllotreta cruciferae
  misc_feature: Act5C
gtaagagtagtaaatagcttagaagcacttgcggtgaacgattccagggccggattcgtcgtattcctgtttggagatccacatctgttggaaagtggaaagagaagccaagatggatccaccgatccatacggagtatttcctttctgggggagcaatgatcttgatcttgattgtgctgggggcaagagcggtgatttccttttgcatacggtcagcaataccagggtacatggtggtaccaccggagagtacagtgttggcgtacaagtccttacggatgtcgacgtcgcacttcatgatggagttgtatacggtttcgtggataccgcaggattccatacccaagaaggaaggttggaagagagcctcagggcaacggaatctttcgttaccgatggtgatgacttgaccgtcgggaagttcgtagctcttttcgagggaggtggaggcggcggcggtggccatttcctgttcgaagtcgagggcgacatagcagagtttctccttgatgtcgcggacgatttccctttcagcggtggtggtgaacgagtaacccctttcggtgaggattttcatgaggtagtcggtcaaatcgcgaccggccaagtccaaacggaggatggcgtggggaagagcgtaaccttcgtagatcggtacggtgtgggttacaccgtcaccggagtccaatacaataccggtggtacgaccggaagcgtagagggagagtacggcttggatggcgacgtacatggccggtgtgttgaaggtttcaaacatgatttgggtcatcttttccctgttggctttagggttaagaggagcctcggtcaagaggacggggtgttcttccggagcgacacggagttcgttgtagaaggtgtggtgccagatcttttccatgtcatcccagttggtgatgataccgtgttcgatggggtatttcaaagtgaggatacctcttttgctttgggcctcgtctcctacgtaggagtccttttgtcccataccgaccatcacaccctgatgtcttgggcgaccgacgatcgaggggaagacggcgcgcggggcgtcgtctccggcgaaaccagccttgcacataccggatccattgtcaacgacaagagccgcaacatcgtcgtcacacatgttgtcttctgtggttga

SEQ ID NO: 526 - DNA, 1167 bp, Phyllotreta cruciferae; identical to SEQ ID NO: 525
  misc_feature: Act5C

SEQ ID NO: 527 - DNA, 1167 bp, Phyllotreta cruciferae; identical to SEQ ID NO: 525
  misc_feature: Act5C

SEQ ID NO: 528 - DNA, 1167 bp, Phyllotreta cruciferae; identical to SEQ ID NO: 525
  misc_feature: Act5C

SEQ ID NO: 529 - DNA, 1167 bp, Phyllotreta cruciferae; identical to SEQ ID NO: 525
  misc_feature: Act5C

SEQ ID NO: 530 - DNA, 1167 bp, Phyllotreta cruciferae; identical to SEQ ID NO: 525
  misc_feature: Act5C

SEQ ID NO: 531 - DNA, 1167 bp, Phyllotreta cruciferae; identical to SEQ ID NO: 525
  misc_feature: Act5C

SEQ ID NO: 532 - DNA, 1167 bp, Phyllotreta cruciferae; identical to SEQ ID NO: 525
  misc_feature: Act5C

SEQ ID NO: 533 - DNA, 1508 bp, Phyllotreta striolata
  misc_feature: Arg. Kinase
gatatcagttgaagatttcaacccgacaacactacaccaagaagagccaccatggtagacgccgccgttttggacaaacttgaatccggtttcaagaaaatcaaggactccgactccaaatcgctgctgaagaagcacctcacccaggagatcttcgacaacttgaagaccaagaagacccccactttcggctcgactcttcttgatgtcatccaatccggcttggagaaccacgactccggcgtaggaatctacgcccccgacgctgaatcgtacaccgtattcgcggacatcttcgatcccatcatcgaggactaccacggcggcttcaagaagaccgacaagcacccgcccaagaactggggcgacgtcagcgtcttcggcgatctcgaccccaccggcgaatacgtcgtctccacccgcgtcagatgcggccgctccctggagggataccccttcaacccctgcttgaccgaggaccagtacaaggagatggagcagaaggtgtccagcaccctctccgggctcgaaggtgaactcaaggggaccttctacccgttgaccggaatgagcaaggacgtgcagcagaagctcatcgacgatcacttcctgttcaaggagggcgatcgcttcctgcaggccgccaacgcttgccgcttctggcccaccggtcgcggtattttccacaacgacgccaagaccttcttggtgtggtgcaacgaggaggaccaccttcgcatcatctccatgcagatgggaggcgacctgggagccgtcttcagacgattggtaaccgccgtcaacgacatcgaaaagagacttccgttctcccacaacgacaggctcggtttcctgaccttctgcccgactaacttgggtaccactgtccgcgcttcggtccatatcaaggtgcccaagttggctgccaacaaggccaagctggaggaggtcgctgccaagtacaacttgcaggtgcgcggtactcgcggtgaacacaccgaggccgaaggcggtgtctacgacatctccaacaagagacgcatgggtctcacggagttcgatgccgttaaggagatgtacgatggcatccaagaaatcattaagattgaaaaagaattgtaaacgttacaaacccctatatattacattcgtcaccattcgtgattttaaaaatatatatgtaagcgatggtatataaatatatatgtacatgtatgtattttacattaagtatctcgtttgccaaaggtattatcgcagataattgctttcaaaaacgctctgtttgtaatttttaagttgttgagataatgtcaagtctgaaacccagcttcattctagtcgacattttgttttcaaatttgattttatttatacaaatgatgtcaaacattgaacaatgttactgtattatttataatttatttttattgtaattctgacaaataaaagtattgtttggaaaacaccaaaaaaacaaaaaaaaaaaaaaaaaaaaaaaaaaaaaa

SEQ ID NO: 534 - DNA, 1508 bp, Phyllotreta striolata; identical to SEQ ID NO: 533
  misc_feature: Arg. Kinase

SEQ ID NO: 535 - DNA, 138 bp, Phyllotreta striolata
  misc_feature: COPI alpha
ctattaaaggaaggaatggatgaaacgatgcccagttcactccgcgatcgtgtccttccaaaacgtgcttcaccacagcatcggcttggccaaatagctcggtggctcccggatttttgaggtggtcttcgaggcccg

SEQ ID NO: 536 - DNA, 138 bp, Phyllotreta striolata; identical to SEQ ID NO: 535
  misc_feature: COPI alpha

SEQ ID NO: 537 - DNA, 231 bp, Phyllotreta striolata
  misc_feature: Rpn6-PB-like protein
gctctcagcaatttacccaaagctcgagccgctctaacttccgctagaacgaccgctaacgctatttattgccctccaaagatgcaggccgccctcgatctgcaatcgggcgtgctgcacgcagccgatgaaaaggatttcaagacagcttactcctatttttacgaagccttcgaagggttcgatagcgtcgaatctcccaaagctctgactgctcttaagtacatgctt

SEQ ID NO: 538 - DNA, 231 bp, Phyllotreta striolata; identical to SEQ ID NO: 537
  misc_feature: Rpn6-PB-like protein

SEQ ID NO: 539 - DNA, 231 bp, Phyllotreta striolata; identical to SEQ ID NO: 537
  misc_feature: Rpn6-PB-like protein

SEQ ID NO: 540 - DNA, 219 bp, Phyllotreta striolata
  misc_feature: 40S ribosomal protein S14
cttacacttggcagcaacttgttgggcagccaacatagcagcataaggagaagactcatcacgatcagccttaacttgcataccaccagtaacacgagagatggtttcacgaccagagagatcggtaacgtgaacgaaagtatcgttgaaagaagcaaagatgtgggcaacaccgaaaacgagttcaccttcacgaacttgaggaccgagagtgacctt

SEQ ID NO: 541 - DNA, 219 bp, Phyllotreta striolata; identical to SEQ ID NO: 540
  misc_feature: 40S ribosomal protein S14

SEQ ID NO: 542 - DNA, 219 bp, Phyllotreta striolata; identical to SEQ ID NO: 540
  misc_feature: 40S ribosomal protein S14

SEQ ID NO: 543 - DNA, 219 bp, Phyllotreta striolata; identical to SEQ ID NO: 540
  misc_feature: 40S ribosomal protein S14

SEQ ID NO: 544 - DNA, 177 bp, Phyllotreta striolata
  misc_feature: Coatomer alpha subunit, putative
tattaaaggaaggaatggatgaaacgatgcccagttcactccgcgatcgtgtccttccaaaacgtgcttcaccacagcatcggcttggccaaatagctcggtggctcccggatttttgaggtggtcttcgaggcccgtggggtgtggtgccacgttcttcttacgcaggcctgttaa

SEQ ID NO: 545 - DNA, 249 bp, Phyllotreta striolata
  misc_feature: 60S ribosomal protein L13
cccagaccagctgccggccctctgcgacccgtcgtgcgctgtcccacagtcaggtaccacaccaaaatacgcgccggacgcggattcaccctgcaagaattaaaagccgcgggacttaacccgagattcgccaggaccgtcggcgtcgccgtcgaccacaggaggaggaacaagtccgtagaatccattcaactaaacgctcaacgtttgaaagaatacaaatccaagttgatcctgttccccatccac

SEQ ID NO: 546 - DNA, 249 bp, Phyllotreta striolata; identical to SEQ ID NO: 545
  misc_feature: 60S ribosomal protein L13

SEQ ID NO: 547 - DNA, 249 bp, Phyllotreta striolata; identical to SEQ ID NO: 545
  misc_feature: 60S ribosomal protein L13

SEQ ID NO: 548 - DNA, 195 bp, Phyllotreta striolata
  misc_feature: Tubulin gamma chain
tatattagtatgattagccaacataagacctgagactcggtgagcggactgaatgtaaggagacttcctcgatagagccacctgtatactagccgggccccaagggatgaactgggcgagtttgcgttcgcgtatcctttgcaacgatttatgcacttgagtagcatccacctctccctgaaataccacaattat

SEQ ID NO: 549 - DNA, 195 bp, Phyllotreta striolata; identical to SEQ ID NO: 548
  misc_feature: Tubulin gamma chain

SEQ ID NO: 550 - DNA, 195 bp, Phyllotreta striolata; identical to SEQ ID NO: 548
  misc_feature: Tubulin gamma chain

SEQ ID NO: 551 - DNA, 195 bp, Phyllotreta striolata; identical to SEQ ID NO: 548
  misc_feature: Tubulin gamma chain

SEQ ID NO: 552 - DNA, 255 bp, Psylliodes chrysocephala
  misc_feature: RpS21
ataatggaaaacgacgcaggagaaaccgttgatttgtactgcccaagaaaatgttctgccagtaacagaattatccatgctaaggaccatgctagcatccaacttagcatagctgatgttgacccagcaactggtagaatgaccgagaactcgaaaagctatgctctttgtggagctattaggagaatgggtgaatcagatgattgcattgtgaggctaacgaagaaagatggaatcttagctaaaaacttttaa

SEQ ID NO: 553 - DNA, 255 bp, Psylliodes chrysocephala; identical to SEQ ID NO: 552
  misc_feature: Sar1

SEQ ID NO: 554 - DNA, 255 bp, Psylliodes chrysocephala; identical to SEQ ID NO: 552
  misc_feature: Sar1

SEQ ID NO: 555 - DNA, 255 bp, Psylliodes chrysocephala; identical to SEQ ID NO: 552
  misc_feature: Sar1

SEQ ID NO: 556 - DNA, 255 bp, Psylliodes chrysocephala; identical to SEQ ID NO: 552
  misc_feature: Sar1

SEQ ID NO: 557 - DNA, 255 bp, Psylliodes chrysocephala; identical to SEQ ID NO: 552
  misc_feature: Sar1

SEQ ID NO: 558 - DNA, 255 bp, Psylliodes chrysocephala; identical to SEQ ID NO: 552
  misc_feature: Sar1

SEQ ID NO: 559 - DNA, 2931 bp, Psylliodes chrysocephala
  misc_feature: COPI Beta
tttaaatactaccgaaaaataaatctacaattcttatttcaccagaatcgcgttctaattaaaatgactgccgttgaacagtcttgttatactttaattaatctaccaactgattcggagccctacaatgaaatgcagctcaaaatggacctcgaaaagggcgaggttaaggtaaaaataagagcacttgaaaggattatacacatgatattagctggagaaagattaccaaacggattcttaatgactattataaggaatgtccttccccttcaggatcatttagctaagaaattacttctaattttttgggaaattgtaccaaaaacttcacctgatggcaaattattacaagaaatgattttagtgtgtgatgcctacagaaaagatctgcaacacccaaacgaatttcttcgaggttctactttaagattcttatgtaaattaaaagaaccagaactgctagaacctctaatggctagtatcagagcctgtttggatcacaggcacagttatgtgcgaagaaatgcagttttggctatttttacaatttatagaaattttgagttcttaattcctgatgcacccgaacttatttctacttatttagatggtgagcaggatatgtcttgcaagagaaatgcttttctgatgcttttacatgctgatcaagatagagcactgtcttatttggcaaattgtctagatcaagttacatcatttggagacattctgcaattggtcattgttgaattaatctataaagtttgccattcaaatcccacagagaggtcaagatttatccgctgcatttacaatctattaaattcaagcagtcctgctgtcagatatgaagctgctggtacacttgtaacactttcaagtgctcccacagcagtaaaagcagctgctagttgttatattgaactaattatcaaggaaagtgataataatgtaaagttgattgtcttggacagattgattgcccttaaggaacatcccagccatgaaagggttttgcaagatttggttatggatatattaagagtgttgcaagctcctgacttggaagttcgcaaaaagactttaaacctagcacttgaactggtatcatctcgtaatatagaagaaatggttttggttcttaaaaaggaggtatcaaaaaccgtagatagcgagcacgaagatacaggaaaatacaggcagttacttgttagaacacttcattcttgttgtataaaattcccagatgtagctgtaactgtcattcctgttttaatggaatttttgtctgatagtaacgagttagctgctactgacgtgttactatttttgagagaggccatacagaagtttgataatctgcaaccacttattattgagaaacttctagaaacattcaaagatataaaatctgttaaagtgcatagagcagctctttggatattgggagaatatgccacttctgtctcagacattgaagctgttattaaagaaattaatcaaaccttaggagaagctcctctgttggaaactgaacaaaaactaatttctggagagacagacgacacaactacagttccaacaggtggagctacaactttggttacttcagatggtacttacgccactcagtctgcctttaattcagtcagtaaatcttcaaaagaaaaacgacctcctctgaggcaatatcttatggatggtgatttttttataggagcgtccttggcttctactctaaccaaattagctttaagatatggtcaaattgcctcagctgctgatagaaataggtttgatgctgaagtcatgcttattatggcaggtatcatacatttaggcaaatcaggtttaccgacaaaaccaataaccaacgatgacaaagaccacatacttttttgcttgcgtgtcatctcagaccgcaccgacccaataatacaaattttctctactctgtgtcgatctgctctcaatgacatgttgatagcgaaggaaacggaagaagccacgactcaaaaatcgaaagaacaatccagacacactatccaaacagatgacgctatcagtttccttcaattagaagcggacaagagcggcgaacttggggaaaatgtattcgaaatgtctttatcacaagccttggtcggaggtagaggtggccaaacagactccctaatcagttccaataaattgaacaagataacacagttgactggattttcggatcccgtatattcagaagcttacgtccacgttaatcaatacgatatagttcttgatgttttaatagtgaatcaaacgaacgacactcttcaaaattgcacgctggaactggcgacgctgggcgatttgaaactcgtagaaaaacctcaacctgtcgtactcgcgcctaaagatttttgtaatattaaggcgaacgttaaggtagcttccacagaaaacggcattatatttggtaatattgtttacgacgtcaccggtgccgcttcagatagaaatgtagtggttttaaacgacattcatatcgatattatggattatattgttcccgcgagctgtacagataccgagtttatgaggatgtgggcagaatttgaatgggaaaataaggtcactgtaaatacacctctcacagacctcgccgattaccttgaccatctcttgaaaagtacaaacatgaaatgtctgacttccgaaaaagcccttagcggtcaatgcggatttatggccgccaatatgtatgccaaatctattttcggagaagacgcgcttgcaaatttgagcatagaaaagcctttcaacaaaccagatgcaccagtcgcagggcacatcaggattagagctaaaagtcaaggaatggctttgagtttaggtgataaaataaatatgacacaaaaaggaactcagagtaaagtagctgctgcatga

SEQ ID NO: 560 - DNA, 2931 bp, Psylliodes chrysocephala; identical to SEQ ID NO: 559
  misc_feature: COPI Beta

SEQ ID NO: 561 - DNA, 2931 bp, Psylliodes chrysocephala; identical to SEQ ID NO: 559
  misc_feature: COPI Beta

SEQ ID NO: 562 - DNA, 2931 bp, Psylliodes chrysocephala; identical to SEQ ID NO: 559
  misc_feature: COPI Beta

SEQ ID NO: 563 - DNA, 2931 bp, Psylliodes chrysocephala; identical to SEQ ID NO: 559
  misc_feature: COPI Beta

SEQ ID NO: 564 - DNA, 2931 bp, Psylliodes chrysocephala; identical to SEQ ID NO: 559
  misc_feature: COPI Beta

SEQ ID NO: 565 - DNA, 2931 bp, Psylliodes chrysocephala; identical to SEQ ID NO: 559
  misc_feature: COPI Beta

SEQ ID NO: 566 - DNA, 2931 bp, Psylliodes chrysocephala; identical to SEQ ID NO: 559
  misc_feature: COPI Beta

SEQ ID NO: 567 - DNA, 2931 bp, Psylliodes chrysocephala; identical to SEQ ID NO: 559
  misc_feature: COPI Beta

SEQ ID NO: 568 - DNA, 2931 bp, Psylliodes chrysocephala; identical to SEQ ID NO: 559
  misc_feature: COPI Beta

SEQ ID NO: 569 - DNA, 2931 bp, Psylliodes chrysocephala; identical to SEQ ID NO: 559
  misc_feature: COPI Beta

SEQ ID NO: 570 - DNA, 825 bp, Psylliodes chrysocephala
  misc_feature: RpL7
agttttgacaaacgacaaccgaaatctttcttttctgtcgtttcgttaaaaatggcaccgacagcggataaggctaaaactgacaaaaaaactaagaccgtaaagggactgcctgcagttcctgaatcggtcttaaaacaccgcaaaagacgtgaagcctctagggctaaaaggcttcaatccattgtaaagaagaagtctgaacaaatcaaaaagagaaaagatattttcaaaagagcagaacagtatgttaaggaatacagattaaaagaacgagatgaaataaggttaattcgtcaagctaaaaataagggtaatttctatgtacctggagaggctaaattggctttcgttatccgtattaagggtatcaataaagtagcaccaaaagtacgtaaagttcttcaacttttccgtctacttcagatcaacaatggagtttttgtaaaactcaacaaagctaccattaacatgcttagaatatgtgaaccttacattacatggggttaccccaatttgaaatctgttagggaattaatttacaagagaggttttgctaaagtgaatggacaaagagtatcaatcactagcaatcagatcattgaagacagattaggaaaatctggcattatctgtattgaagatttgattcatgaactgttcactgttggatccaggttcaaatatgcctccaacttcttatggcccttcaagctaaacacaccaactggtggctggcgtaagaagaccaatcactatgtagaaggtggtgactttggtaatagagaagataaaataaatgaacttctcagaagaatggtttaa

SEQ ID NO: 571 - DNA, 825 bp, Psylliodes chrysocephala; identical to SEQ ID NO: 570
  misc_feature: RpL7

SEQ ID NO: 572 - DNA, 825 bp, Psylliodes chrysocephala; identical to SEQ ID NO: 570
  misc_feature: RpL7

SEQ ID NO: 573 - DNA, 825 bp, Psylliodes chrysocephala; identical to SEQ ID NO: 570
  misc_feature: RpL7

SEQ ID NO: 574 - DNA, 825 bp, Psylliodes chrysocephala; identical to SEQ ID NO: 570
  misc_feature: RpL7

SEQ ID NO: 575 - DNA, 825 bp, Psylliodes chrysocephala; identical to SEQ ID NO: 570
  misc_feature: RpL7

SEQ ID NO: 576 - DNA, 825 bp, Psylliodes chrysocephala; identical to SEQ ID NO: 570
  misc_feature: RpL7

SEQ ID NO: 577 - DNA, 825 bp, Psylliodes chrysocephala; identical to SEQ ID NO: 570
  misc_feature: RpL7

SEQ ID NO: 578 - DNA, 825 bp, Psylliodes chrysocephala; identical to SEQ ID NO: 570
  misc_feature: RpL7

SEQ ID NO: 579 - DNA, 825 bp, Psylliodes chrysocephala; identical to SEQ ID NO: 570
  misc_feature: RpL7

SEQ ID NO: 580 - DNA, 825 bp, Psylliodes chrysocephala; identical to SEQ ID NO: 570
  misc_feature: RpL7

SEQ ID NO: 581 - DNA, 1149 bp, Psylliodes chrysocephala
  misc_feature: COPI Zeta
aagatggtatgtggtaaagatggtaaagaagacaaagaccatcttctctatacgaaaaagtttttagaagtgaaaaaacttttacttttgggaactggcgagtctggaaaaactacgatcatcaaacagatgaaaattttacatattaatggttactcagataatgaaagaaaagaaaaaatcccatacatcaaacaaaatattcatgaatctatctatgacatcatcactaatatgaataaaattaatcctcctgtcaaagtcaaaaacgaggaaactataaattcgatcgatttcatcgtgaaaataggccaagaaggaccaaatgaatttactccggaatactttaatcacgtaaaaaaagcttgggcagatgaaggtgtcaaagaaacgtttaatagatccaatgagtatcaacttattgatagtgcagaacatttcttaaaccaaatcgatgtcatccaaacatcgggtttcattccaacgaatcaagacattctattctgtcgaatcaaaacaatctcgattagcaaaatagacttcgaaataccgattccgaaaaaatacggaggcggcatggctgaattctggatgttcgatgtaggcgggcaacgtggcgaaagaaaaaaatggataaaagtgttcgccggcattcaggctattctatttttaatagcgtccagcgattttgatttgaaattaagagaagacgaaagcgttaatagacttcaggagtcttttaatctgtttcaagatatctattcaaatgtgtatgttaaagatgccgcaatgattgtttttctgaataagcaagacatacttcaaaggaagatcgaacaaggaagaaaaatagagaaatactttccggaatattcgaattttacaccttcgggaagagaagaatgcaatacagagtatgaaaaagttagattgtttatgaaaaacaagattttaggaattgcaagaatgcctgtattcgtagaaaatatgggaatgagaccaggtaaaaatatcaccgaacagctaaaaccgagggatgtatatatccacaataccatagcaacagatacgaaaaatatcagaaaagttttcgattctgttcacgagagcatccttcaaaaaatcgtcaaagacactggtattttgtaa

SEQ ID NO: 582 - DNA, 1149 bp, Psylliodes chrysocephala; identical to SEQ ID NO: 581
  misc_feature: COPI Zeta

SEQ ID NO: 583 - DNA, 1149 bp, Psylliodes chrysocephala; identical to SEQ ID NO: 581
  misc_feature: COPI Zeta

SEQ ID NO: 584 - DNA, 1149 bp, Psylliodes chrysocephala; identical to SEQ ID NO: 581
  misc_feature: COPI Zeta

SEQ ID NO: 585 - DNA, 1149 bp, Psylliodes chrysocephala; identical to SEQ ID NO: 581
  misc_feature: COPI Zeta

SEQ ID NO: 586 - DNA, 1149 bp, Psylliodes chrysocephala; identical to SEQ ID NO: 581
  misc_feature: COPI Zeta

SEQ ID NO: 587 - DNA, 1149 bp, Psylliodes chrysocephala; identical to SEQ ID NO: 581
  misc_feature: COPI Zeta

SEQ ID NO: 588 - DNA, 1149 bp, Psylliodes chrysocephala; identical to SEQ ID NO: 581
  misc_feature: COPI Zeta

SEQ ID NO: 589 - DNA, 1149 bp, Psylliodes chrysocephala; identical to SEQ ID NO: 581
  misc_feature: COPI Zeta

SEQ ID NO: 590 - DNA, 1149 bp, Psylliodes chrysocephala; identical to SEQ ID NO: 581
  misc_feature: COPI Zeta

SEQ ID NO: 591 - DNA, 3084 bp, Psylliodes chrysocephala
  misc_feature: Rpn2
atttccgaaaattttaattgtgcttgcaacgaaaacttattaagattttcaagtgcttttaaaatgaatattacttcagctgcggggataatatccctactagaagaaccaagaccagaattgaaagtatttgctctaaaaaaattagattccattgttgatgaattttggccagagatttcagaagctatcgagaaaattgaaattcttcatgaagacaaagtatttcaacagcaccaactggctgcattggtagcaagtaaagtttactaccatttgggagcatttgaagattccttaacatacgctttgggtgctggcgatctttttgatgtaaacgcccgaacagagtatgtggaaacgacacttgccaaatgtattgattattacacacaacatcgcattgctttggctgaaggcgtacgagatgcaaagcccattgatgccagacttgaggccattgtgaatcgtatgtttcaacgttgtttagatgacggacaaaaccgacaggccatgggactcgctttggaaactagaagaatggacatttttgaattgtccattacacaagctgatgacattattggtatgctgacctatgcttttcaggtcgctatgagtttgatccaaaaccgcgcattccgaaacaccgtcctgaggtctctagttggtctgtatcggggtctaactactcccgattacgtcaatatgtgccagtgtctaattttcttagacgaccctctcccagtggctgaaatcttagataaactcgtgtctggtaaagaagatactgaactgatggcctaccaaatagcattcgacctatacgagtcagcaactcagcagtttttggagagggtattggtagctcttagagctactgctccgattccgtcgctgctggaagagaaggctaaacccaagattggcgatcaagccagtagcacttcagctgaggcttcgactggcgatgccactgttagtgaatcaaagactgaagttgttaaggaagagaaatctattgatagtttgtctgatcatgaaaaagaacaccagaaacgtatcgaaaagttacacaccattctttcaggcgaagtgtccatcgaacttcatcttcaatttcttatcagatctaatcatgctgatctccttattttgaaacaaacaaaagaaaccgtccgcgttagtatttgtcatactgctaccgttatagctaatgctttcatgcacagcggtaccaccagtgatcaatttttaagagataacttagaatggttagcaagggctacaaattgggccaaactcacggctacggcttctcttggcgtaattcacaggggacacgagcaagaagctttgaccttaatgcagagctacttgcctaaagaagtggggcccagttccggatattcggaaggcggcgggctgtacgctctcggtctcatacacgccaaccacggcgctaatatcatcgattacctactcggtcagctgaaagatgctcagaacgaaatggtcagacacggtggttgtctgggtctcggtttggccgccatgggtacccacaggcacgacgtttatgaacaactcaaattcaatctctatcaagacgacgcgaataccggagaagccgctggtatagccatgggtatggtcatgttgggctccaataattcggcaactataatggatatggtggcgtacgcacaagaaagtcaacatgaaaaaatcctgcgtggattagcagtgggtataagtttcacgatgtacggtcgtctagaagaggccgattcactaatccatcagctgacttcagataaggatccaattttaagacggtccggaatgtataccttagccatggcttactgcggtactggacacaatcaagccatcaggaaattactacacgtagcggtgtcagatgtcaacgatgatgtccgaagagctgcagttacagctcttggtttcttgttattcagaacacccgaacaatgtccaagcgtagtttccctcttagccgaaagttacaatccacacgtgcgctacggagccgccatggctctaggtatcgcatgcgcgggaaccggtctgcgcgaagccatagccttactcgaaccgatggtcatgttcgatcccgttaactttgtgcgacagggcgctctcatcgcttccgccatgatcctcattcaacaaacggaacagacttgtccgaaggtcagttttttcaggcagacgtacgcttcagtcatttccaataagcacgaagacgttatggctaaatttggcgctattttagctcaaggaataatcgatgctggtggcaggaacgtcactttatcattacaatctagaactggtcacactaatatgttggctgtggtgggaacactggtgttcacacaatattggtactggttcccattgtctcattgcttggccttggcctttactcctacgtgtgttattgcgttaaatacacaactaaagatgcctaaattggaattcaagtcgaacgccaagcccagcctttatgcctatccggcgcccatggaggaaaagaaacgcgaagaacgggaaaaagtgacgacagcggtgctgagtatagccgctaggcagcgcaggagagaccacgaaagaaagcatcgcgacgaaaaaatggacgtggacgaagaaaaggacgacaaaaaaaccgaaaaggaagaaaagaaaccggaagaaaaaaaggaagacaagaagcccgaagagaagaaagcggacgacaagaaaccttcaacttcgacggccgatgataaaaaggaaaagaaagacgaaaaggaggagaagaagaaggaacccgaaccgaatttcgaaatcttgcaaaatcctgccaggaccatgaggcagcaattgaaggtgatcacaatcaacgatagcacgcagtacacggcgatgaaagatgtttcgataggcggcatcatcatggtgcgaaatttgaagcctggcgaagaagaattggtagaacctgtagcagcttttggtccaaagggcgaggatgaaaaagagccagaaccaccagaaccttttgaatggactgaggattag

SEQ ID NO: 592 - DNA, 3084 bp, Psylliodes chrysocephala; identical to SEQ ID NO: 591
  misc_feature: Rpn2

SEQ ID NO: 593 - DNA, 3084 bp, Psylliodes chrysocephala; identical to SEQ ID NO: 591
  misc_feature: Rpn2

SEQ ID NO: 594 - DNA, 3084 bp, Psylliodes chrysocephala; identical to SEQ ID NO: 591
  misc_feature: Rpn2

SEQ ID NO: 595 - DNA, 3084 bp, Psylliodes chrysocephala; identical to SEQ ID NO: 591
  misc_feature: Rpn2

SEQ ID NO: 596 - DNA, 3084 bp, Psylliodes chrysocephala; identical to SEQ ID NO: 591
  misc_feature: Rpn2

SEQ ID NO: 597 - DNA, 3084 bp, Psylliodes chrysocephala; identical to SEQ ID NO: 591
  misc_feature: Rpn2

SEQ ID NO: 598 - DNA, 3084 bp, Psylliodes chrysocephala; identical to SEQ ID NO: 591
  misc_feature: Rpn2

SEQ ID NO: 599 - DNA, 3084 bp, Psylliodes chrysocephala; identical to SEQ ID NO: 591
  misc_feature: Rpn2

SEQ ID NO: 600 - DNA, 672 bp, Psylliodes chrysocephala
  misc_feature: snf7/shrb
tttaaaatgagctttttcaataaaatattcggagggaaagaaaaagatgaaggtcctaccccaggcgaagctatccagaagcttagagaaactgaagaaatgttatacaaaaaacaggaatttttagaaaagaaaatagaagaatacacattattagctaagaaaaatgcctctaagaataaacgagtggcccttcaagctcttaagaagaagaaaagattggaaaagactcaactgcaaatcgatggaacacttacaactattgaaatgcaaagggaagccctcgaaggagctagtactaacacagcggttttagattctatgaaaaatgctgctgatgcccttaaaaaagcacacaagaacctggatgttgataatgttcatgatataatggatgatatagcggaacaacacgacattgccaatgagatcacaaacgctattagtaatccagttggtttctcagatgatatggatgaagatgaattagaaaaggaactggaggagctcgaacaagaaggtttagaagaagatttactcaaggttcccggacctacagaacttccagccgtgcccgctggagctattgctaagccggcagttgttaaacctgcagctagaaaagtcgaggatgacgatgatatgaaggaattagaagcatgggcatcataa

SEQ ID NO: 601 - DNA, 672 bp, Psylliodes chrysocephala; identical to SEQ ID NO: 600
  misc_feature: snf7/shrb

SEQ ID NO: 602 - DNA, 672 bp, Psylliodes chrysocephala; identical to SEQ ID NO: 600
  misc_feature: snf7/shrb

SEQ ID NO: 603 - DNA, 672 bp, Psylliodes chrysocephala; identical to SEQ ID NO: 600
  misc_feature: snf7/shrb

SEQ ID NO: 604 - DNA, 672 bp, Psylliodes chrysocephala; identical to SEQ ID NO: 600
  misc_feature: snf7/shrb

SEQ ID NO: 605 - DNA, 672 bp, Psylliodes chrysocephala; identical to SEQ ID NO: 600
  misc_feature: snf7/shrb

SEQ ID NO: 606 - DNA, 672 bp, Psylliodes chrysocephala; identical to SEQ ID NO: 600
  misc_feature: snf7/shrb

SEQ ID NO: 607 - DNA, 672 bp, Psylliodes chrysocephala; identical to SEQ ID NO: 600
  misc_feature: snf7/shrb

SEQ ID NO: 608 - DNA, 672 bp, Psylliodes chrysocephala; identical to SEQ ID NO: 600
  misc_feature: snf7/shrb

SEQ ID NO: 609 - DNA, 672 bp, Psylliodes chrysocephala; identical to SEQ ID NO: 600
  misc_feature: snf7/shrb

SEQ ID NO: 610 - DNA, 672 bp, Psylliodes chrysocephala; identical to SEQ ID NO: 600
  misc_feature: snf7/shrb

SEQ ID NO: 611 - DNA, 2160 bp, Psylliodes chrysocephala
  misc_feature: Vps27
atcagctattcttacaacaaaatgtttcgcaatagaaattttgatgcattgcttgaaaaagcaaccagccatttattaatggagctagatttagcatctacgctgcagatgtgcgatttgattagacagaatgatgtacaaccaagatatgccttaactgcattaagaaagaaactatactcacaaaatcctcattctgcattgtatgctttgttagttttggaaagtatggtaaaaaattgtggcataatagttcatgaagaattaaccactaaatcattctgtgatttccttcatgaattatcaaaaaccacacctcatgaaaatgttcgaagtaaactgttagaacttattcaaacctggaattttgtctttaggaagaatcctaaacatggagcgcttaaggaccttgtgaatacaatgaaaatggaaggtcacaaatttccaacacccagagaatcagatgcaatgttttcatctgacacagccccagaatgggctgatggagatgtgtgtcatagatgtcgtgtacaattcagtgtactccaaagaaagcatcattgcagagcctgtggtcaagtgttttgtggccagtgcacttcaaagacttctactttgcccaaatatggaattgaaaaggaggtgagagtatgtgatgcttgttatgatgaagttactaaaccagccactgcatcaaaatcttctatttcttccagtgaaacagatttgcctgaggaatatttaaaaagttcattggcacaacagaaacaggatcctcctaagaaaagtgaagatgaattgagagaagaggaggaactgcaattagctttagctttgagtcaatcagaagctgaagccaaagaaaaagaaaaaataagggcaacaagtgctttgtataatgtgaaagaaccaacaccagtcgaaagaccacaaactcctcctcagcctcaagaagatccagaattggctagatatttgaatcgttcctattgggaatcgcttaaaaccaacgatccaaacgatcgtcccacgagtccgtcggctccagctaccgctccatctcaaaacatcgaacccaaatttaagaccaaggaaaacggtttggcggaaaacgatcttgaagagtttatgagaacccttaaaggtcacgtcgaaattttcattaacaggatgaaaagtaactccagtagaggaagatcgatcgctaacgacacgagcgtgcaaactttgtttatgaacataacggcgatgcattcgcgacttctgcattacatccaagaacacgacgacagtcgcatccactacgaatgcctgcaagacaaaatgactcaagtaaaagacgcgagggctgctttggacgctctgcgcgaagaacacaatgaaaagatgagaagagaggctgaggagcaagaaagaatgcgtcaaatgcaaatggcgcataaattggaagtcatgaggaagaaaaaacaggaatatcttcagtaccagagacaattggcgctacaaaggatccaagaacaagagagagaaatgcaaatgagacaggaacagcaaaaacagcaatatatgttacctcaatatggatatatgaattctccacatcatggacaacagtttccttccaacccgaaccagtccatgggtaattacaacacttattcatttcctcagcacatgatgcctccgcaaagcgttccgagtcaagtcggtttacctggaggaccaccacatggtcctctagggcagcaaccagctcataatactgctttaggccctccgcccggctttcctcaaggagtaacttcgaattcttcactgcctaatggcgccccgcagtttgtaggacacggcgtatcgtctcaacatatgatgggcggcggacaacctggcttgcctcccaattctccgaatacccaacagggaatacctcaacatcagggcgggattccccataatcagggtggaatgatgccccctcaaggtggactgccgccgcagcagggtgggattcccatgcaaggaggaatttctcagaatcaaaattttccgcatcaaggacagatgtcgccccaatttcagcagcctggagctccaccggctagtccacaagtcaaaacaaatggagaggcacaaactgcagagttaataagttttgattag

SEQ ID NO: 612 - DNA, 2160 bp, Psylliodes chrysocephala; identical to SEQ ID NO: 611
  misc_feature: Vps27

SEQ ID NO: 613 - DNA, 2160 bp, Psylliodes chrysocephala; identical to SEQ ID NO: 611
  misc_feature: Vps27

SEQ ID NO: 614 - DNA, 2160 bp, Psylliodes chrysocephala; identical to SEQ ID NO: 611
  misc_feature: Vps27

SEQ ID NO: 615 - DNA, 2160 bp, Psylliodes chrysocephala; identical to SEQ ID NO: 611
  misc_feature: Vps27

SEQ ID NO: 616 - DNA, 2160 bp, Psylliodes chrysocephala; identical to SEQ ID NO: 611
  misc_feature: Vps27

SEQ ID NO: 617 - DNA, 2160 bp, Psylliodes chrysocephala; identical to SEQ ID NO: 611
  misc_feature: Vps27

SEQ ID NO: 618 - DNA, 2160 bp, Psylliodes chrysocephala; identical to SEQ ID NO: 611
  misc_feature: Vps27

SEQ ID NO: 619 - DNA, 2160 bp, Psylliodes chrysocephala; identical to SEQ ID NO: 611
  misc_feature: Vps27

SEQ ID NO: 620 - DNA, 2160 bp, Psylliodes chrysocephala; identical to SEQ ID NO: 611
  misc_feature: Vps27

SEQ ID NO: 621 - DNA, 2160 bp, Psylliodes chrysocephala; identical to SEQ ID NO: 611
  misc_feature: Vps27

SEQ ID NO: 622 - DNA, 2730 bp, Psylliodes chrysocephala
  misc_feature: COPI Beta Prime
aatctcaaaatgccacttcgtttagacataaaaagaaggctaacagcccgttctgaccgggtaaaatgtgtagacctccatcctacagaaccctggatgctctgctccctttacagcggaaacataaacgtctggaatcatgaaaatcagcaactcgttaaaacttttgaagtatgtgatctgccagtgagagctgcaaaatttgtaccaagaaaaaattggattgtcagtggatctgatgatatgcagataagggtttttaattataataccctagatagagttcatgcctttgaagcgcattctgattatgttagatccattgttgtacatcctacacagccatatattctaacaagtagtgatgatatgcttatcaaattatggaattgggaaaaagcatgggcctgccaacaggtgtttgaaggccacatccattatattatgcaaatttccataaaccctaaagacaacaacacctttgccagtgcttctttagacaggaccataaaagtctggcaattgggtgcttccactgcaaatttcactctcgaaggtcatgaaaaaggagtaaactgtgttgattattaccatggaggtgataaaccatacctaatatctggtgcagatgatagattagtcaaaatttgggattaccagaataaaacttgtgtccaaactttagaaggacatggacaaaacgttactgctgtttgtttccatcctgaactcccaatagctcttactggaagtgaagatggtactatcagagtttggcatgcaaatactcacagattagaaagcagtttgaactatggctttgaaagagtatggactattttctgcttgaagggttccaataatgttgctttaggttatgatgagggtagcattttggtgaaagttggtagagaggaaccagctgttagtatggatgcaagtggtggaaaaattatttgggctagacattcagaattgcagcaggctaacctcaaggctcttccagagggtgctgaaattagggatggtgaacgccttccagtttctgtgaaagatatgggtgcatgtgacatctacccacaaactatccagcacaatccaaatggtcgtttcgtggtagtttgtggagatggagaatacatcatttacacagctatggcattaaggaacaaagcttttggaagtgcccaagagtttgtgtgggctcaagattcaagtgaatatgctatcagggaatctggatctacaattagaatatttaaaaatttcaaagaaaagaagaatttcaaatctgattttggtgctgaaggtatatttggaggctaccttctgggtgtaaaatctgtttctggattgactttctatgattgggaaactttggatttggttagaagaattgaaatacaaccacgggcaatatattggtctgacagtggcaaattagtttgcttggccactgaagatagttattttatactctcatatgattctgatgaagtacaaagggccaaagacaataatcaggttgctgatgatggagttgaatcggcttttaatctcttgggtgaaattaatgagtctgtacgtactggtctatgggtaggagattgtttcatttacacaaattctgtaaaccgtataaattactttgttggaggtgaacttgtaacaatagcccatctagatggaccactttatgttcttggttatgtccctaaagatgacaggctttatttagtagacaaagaactaagagtagttagctaccagctccttctttcagtcttagaatatcaaactgctgtgatgaggagagatttttcaactgctgatagagtcttgccttctattccaaaagagcatagaaccagagtggcacatttcttagaaaagcaaggttttaagcaacaagctttggcagttagttcagatcctgaacatagatttgaactagcagttgcactagaagatctaaacacagccagagccttagctcaggaagctaataaccctcagaaatggagccaacttgccgaacttgcagcttctacgaacaatctagaattagccaaagaatgtatgcagaaggctcaagattacggagggttgctacttttagctactagctcaggagatgaaaaagtagtaagggcgctaggggatgccactcaaacagaaggcaaacataatctatctttcttgtctcatttcttagttggcgatttaaataaatgtctgaatatattgataacaactggaagacttccagaagcagctttctttgcgaggtcttacttacctgataaaatctcagaagtggtagatctctggagaacacagttgtctactatcaatcagaaagcaggacaaagcttggcagatcctaaagattatgaaaatctgtttcctggtcttcaagaagcaatagtagcacagaaatttttggaacaaaataaccctggatttactccagcaatgttagcaaccagtatcaccccaaatcatgaaagaaacgttatagctgaggtggaagcccagtcgaagaatagtggagtaactgggagttcttctcaatattctgtgaaggcacctattgagcaattgaagaaactctcaattgatcaagatgatgatgacgacgacatagatttagacctggatggtgtgaatatagatgaaaatatagacacaacggatatcaacatagatgacgatttgttgagcgattga

SEQ ID NO: 623 - DNA, 2730 bp, Psylliodes chrysocephala; identical to SEQ ID NO: 622
  misc_feature: COPI Beta Prime

SEQ ID NO: 624 - DNA, 2730 bp, Psylliodes chrysocephala; identical to SEQ ID NO: 622
  misc_feature: COPI Beta Prime

SEQ ID NO: 625 - DNA, 2730 bp, Psylliodes chrysocephala; identical to SEQ ID NO: 622
  misc_feature: COPI Beta Prime

SEQ ID NO: 626 - DNA, 2730 bp, Psylliodes chrysocephala; identical to SEQ ID NO: 622
  misc_feature: COPI Beta Prime

SEQ ID NO: 627 - DNA, 2730 bp, Psylliodes chrysocephala; identical to SEQ ID NO: 622
  misc_feature: COPI Beta Prime

SEQ ID NO: 628 - DNA, 2730 bp, Psylliodes chrysocephala; identical to SEQ ID NO: 622
  misc_feature: COPI Beta Prime

SEQ ID NO: 629 - DNA, 2730 bp, Psylliodes chrysocephala; identical to SEQ ID NO: 622
  misc_feature: COPI Beta Prime

SEQ ID NO: 630 - DNA, 2730 bp, Psylliodes chrysocephala; identical to SEQ ID NO: 622
  misc_feature: COPI Beta Prime

SEQ ID NO: 631 - DNA, 2730 bp, Psylliodes chrysocephala; identical to SEQ ID NO: 622
  misc_feature: COPI Beta Prime

SEQ ID NO: 632 - DNA, 2730 bp, Psylliodes chrysocephala; identical to SEQ ID NO: 622
  misc_feature: COPI Beta Prime

SEQ ID NO: 633 - DNA, 1140 bp, Psylliodes chrysocephala
  misc_feature: Actin 5c
cctatcaaaatgtgtgaagaagaagttgccgctttagttgtagacaatggatccggtatgtgcaaggccggtttcgccggggatgacgcgccccgtgccgtattcccatccatcgtcggacgcccaagacatcagggtgtaatggtaggaatgggacaaaaagactcttacgtaggagatgaagcccaaagcaaaagaggtatcctcacattgaaataccccattgaacacggtatcatcaccaactgggatgatatggaaaagatctggcatcacaccttctacaacgaactccgtgtcgccccagaagaacaccccgtcctcctgacagaagctccactcaaccccaaggcaaacagagaaaagatgacccaaatcatgtttgaaaccttcaacacacccgccatgtatgtagccatccaagccgtactttccctgtacgcttccggtcgtaccacaggtatcgtattggactccggagatggtgtcacccacaccgtaccaatctacgaaggttacgcccttccccacgccatcctccgtttggacttggctggtcgtgatttgaccgactacctcatgaaaatcttgaccgaaagaggttactcattcaccaccacagctgaaagagaaatcgtccgtgacatcaaggagaaactttgctatgtcgccctcgacttcgaacaggaaatggccaccgctgccgcttcaacctctttggaaaagagctacgaacttcccgatggacaggtcatcaccatcggtaacgagagattccgttgtccagaagccctcttccaaccttccttcttgggtatggaatcttgcggtatccacgaaaccgtctacaactccatcatgaagtgtgacgttgatatccgtaaggacttgtacgccaacaccgtactttccggaggtaccaccatgtaccctggtatcgccgacaggatgcaaaaagaaatcaccgccttggctccaagcaccatcaagatcaagatcatcgcacccccagaaaggaaatactccgtatggatcggtggatccatcttggcttccctgtccaccttccaacagatgtggatctccaaacaggaatacgacgaatccggccctggaattgtccaccgcaagtgcttctaa

SEQ ID NO: 634 - DNA, 1140 bp, Psylliodes chrysocephala; identical to SEQ ID NO: 633
  misc_feature: Actin 5c

SEQ ID NO: 635 - DNA, 1140 bp, Psylliodes chrysocephala; identical to SEQ ID NO: 633
  misc_feature: Actin 5c

SEQ ID NO: 636 - DNA, 1140 bp, Psylliodes chrysocephala; identical to SEQ ID NO: 633
  misc_feature: Actin 5c

SEQ ID NO: 637 - DNA, 1140 bp, Psylliodes chrysocephala; identical to SEQ ID NO: 633
  misc_feature: Actin 5c

SEQ ID NO: 638 - DNA, 1140 bp, Psylliodes chrysocephala; identical to SEQ ID NO: 633
  misc_feature: Actin 5c

SEQ ID NO: 639 - DNA, 1140 bp, Psylliodes chrysocephala; identical to SEQ ID NO: 633
  misc_feature: Actin 5c

SEQ ID NO: 640 - DNA, 1140 bp, Psylliodes chrysocephala; identical to SEQ ID NO: 633
  misc_feature: Actin 5c

SEQ ID NO: 641 - DNA, 1140 bp, Psylliodes chrysocephala; identical to SEQ ID NO: 633
  misc_feature: Actin 5c

SEQ ID NO: 642 - DNA, 3687 bp, Psylliodes chrysocephala
  misc_feature: COPI Alpha
cggaagaacaccttgaaaatgttaacgaaattcgaaaccaaatctgctagggtaaaagggctgtcttttcaccccaaaagaccttggattttggcaagtttgcataacgggtgtatccagttatgggactaccgtatgtgcacccttttggaaaagtttgacgagcatgatggacctgtgagagggatatgttttcatagtcaacaacctctatttgtatcaggtggtgatgattataagataaaggtgtggaactacaagcaaaaacgatgtatttttacgttattgggtcatttagattacattcgtaccacaatgttccatcatgagtatccttggattgtgtctgcatctgatgatcagactataagaatttggaattggcaatcaaggacttgcatttgtgtcctcacaggtcacaatcattatgtcatgtgtgctacattccatccaactgatgatttattagtttctgcttcattggattctacagttagggtctgggatatttcaggtctgcgtaagaagaatgtagctccaggacctgcaggtcttgaagagcatctcaagaatcctggttcaactgatttatttggacaagctgatgctgtagttaagcatgttttagagggacatgaccgtggtgtaaactgggcttcatttcatcctacacttcctttaatagcctctggggcagatgataggcaaatcaaactgtggagaatgaatgattcgaaagcttgggaggtggatacatgcaggggacattacaataatgtctcttgtgtattattccatcccaggcaagagctgctactatcaaatggtgaagataggagtatcagggtttgggatatggctaaaaggacgtgtttgcatacttttagaagggaacatgaacgtttttgggtcatgaccagtcatcctaatctgaatttattcgctgctggacatgatggtggaatggtcatcttcaagctagaaagagaacgcccagcttatacggtacacggcaacctgctgtactacgtaaaagaacggtttttgagaaaactcgactttaccacgtccaaagacgtgcccgttatgcaaatcaggggcggaggtaaaattccggtatacagaatgtcttttaatcccgcagaaaatgccgttctactttcgacgcgcacttccaatttggataacagcacttacgatctgtacatgattcccaaagatcaagaacgcgaagatcacgttccagaggcagaaagtaagagatcctctggtttgacggctctttgggtggcgagaaaccgtttcgctgtcttagataggacccaccaattgatcatcaagaatttaaagaacgaagtcaccaaaaaggtccaaactcccacgtgcgatgaagttttttatgccggcaccggcatgctactgcttagagattcggaacacgtaacgttgttcgacgtacaacagaaaaggactttggctcaagttaaaataaataaatgcagatacgtggtctggtcatcggatatgtcgcacttggcgcttctctccaaacataatgtgacagtttgtaatagaaaattagacgtcctgtgctctttacacgaaaatactcgagtaaaatcaggagcttgggacgatagcggtgtatttatctatactaccagcaatcacatcaagtatacccttaaaaacggcgatcacggaatcatcagaacactcgatcttcctatatacataactagagtgaggggaagtcaagtgttttgcttggatagggaatgcaagccgcgtctattggtcatcgatccaaccgaatacaaattcaaactggctttaatcaaccacaaatacgaagaagtcttgtacatggttagaaattcgcgattggttggtcagagcatcatttcttacttgcaacaaaaaggttatcctgaggtggcgttgcatttcgtcaaagacgacaagacgcgattcacgttggctctggagtgcggcaacatcgagatagctttggaggcggctaaagcgctcaacgataagaattgttgggatcagctggcacaagcagcgctgtggcagggcaatcatcaagtcgtcgaaatgtgctaccaacgcaccaagagtttcgagaaattgtctttcctgtatttgatcaccggcaatttggaaaagttgagaaaaatgatgaaaatcgctgaaattcgcaaggccaggtcgtctcaataccacgctgcgcttttattgggcgatcttgaggaaagagtgaaggtcttgaaggcctcgaaccagctgtctttggcatatttgacagccgccacccatggaatgagagaagaagccgatcagttaaaagaacaaataggagacacgaaaaaggtaccggatgtggatccgaacgccaaattcttgaaacccccaccgccgatacagcaagccgagtccaactggcctttgttgactgttagcaggagcttcttcgaaaacaccgcagccgtagctacagcttcggccaacatgaaatctttaatggccgaaccgatatccgacgtagcaatggaggaagcccaaggttggggcgatgatgacgagctggagctcgatcccgacgagaagaaacccgacactgcggccgccggtggtgacggtgaagctggttgggacgtcgaagacgaaggattggaaatacccgatctaggaccgacggcaacggccgaagtcgagggtaatttcgtccatctacccacaccaggtccgtctccgcctttaacttggactaaaaactctcaactggtggccgatcacgtagcggcaggttctttcgaatcggctgctagattgcttcacgatcagctgggcgtggtagatttcaagcctttcgaaagtctcttcttgaacctctacagcacgtccaagacagtttcttcttggcaacaaaacgtcccaccttcgttcagttatcctttgaggaattggaaggaggcgaatatcaagaatcaattgcctgcttccggggtcaaattgaacgatttggtcgctaaattgcagatctgttatcaattgacgacgggcggaaagttcacggaggccatcgaaaaactacaaactctgctgttgtccgtcagccttttggtcgtcgacaacaaacaggagattacggaagcccagcaattgctgagaatagccagcgagtacatttgcggactgcaaatggaaactttgcgcaaaaccatgccgaaaacgtcgcctgaagagcagaaacgtcagtgcgagatggccgcttacttcacgcactgcaaattacagcccatccatcaaatcctgaccctcaggaccgctttgaacatgtttttcaagctcaaaaactataaaaccgcagcttcgttcgccaaaagacttctggaactgggtcctagaccggaagtcgcgcagcaggctaggaaaatcctgcaggcctgcgattccaatctgacggacgatattcaactgcattacgacgagcacaatccattcaatttgtgcggtcattcgtacacgccgatatacaggggcaaagcggaggagaagtgtccgttgtgcggtaccagctacttgcctaaattcaaaggagtgttgtgtaatatttgtaaggtagctgaggtcggtaaggatacgattggattgagaataagtacccaccagtttagatag

SEQ ID NO: 643 - DNA, 3687 bp, Psylliodes chrysocephala; identical to SEQ ID NO: 642
  misc_feature: COPI Alpha

SEQ ID NO: 644 - DNA, 3687 bp, Psylliodes chrysocephala; identical to SEQ ID NO: 642
  misc_feature: COPI Alpha

SEQ ID NO: 645 - DNA, 3687 bp, Psylliodes chrysocephala; identical to SEQ ID NO: 642
  misc_feature: COPI Alpha

SEQ ID NO: 646 - DNA, 3687 bp, Psylliodes chrysocephala; identical to SEQ ID NO: 642
  misc_feature: COPI Alpha

SEQ ID NO: 647 - DNA, 3687 bp, Psylliodes chrysocephala; identical to SEQ ID NO: 642
  misc_feature: COPI Alpha

SEQ ID NO: 648 - DNA, 3687 bp, Psylliodes chrysocephala; identical to SEQ ID NO: 642
  misc_feature: COPI Alpha

SEQ ID NO: 649 - DNA, 3687 bp, Psylliodes chrysocephala; identical to SEQ ID NO: 642
  misc_feature: COPI Alpha

SEQ ID NO: 650 - DNA, 3687 bp, Psylliodes chrysocephala; identical to SEQ ID NO: 642
  misc_feature: COPI Alpha

SEQ ID NO: 651 - DNA, 3687 bp, Psylliodes chrysocephala; identical to SEQ ID NO: 642
  misc_feature: COPI Alpha

SEQ ID NO: 652 - DNA, 3687 bp, Psylliodes chrysocephala; identical to SEQ ID NO: 642
  misc_feature: COPI Alpha

SEQ ID NO: 653 - DNA, 1146 bp, Psylliodes chrysocephala
  misc_feature: VATPase D
atatcatatgacatttggggtgaggtgttttcatctcgtgagtttttttgtacagttcttcgtacttctccaagacaacttacaaaatcaactacaatcatgaagggctgtctttacaacatcgacaacggatatttagaaggattatgtcgtggattcaagtgcggaatcctgaaacaaagcgactatctaaatttagttcagtgcgagacccttgaagatttgaaactgcatttacaaggtaccgattacggaactttcttggctaacgagccctcgcccttggcggtgtcgaccatcgactccagattgagggaaaaacttgtgatcgagtttcagcatatgcgtaatcaagccgtagagcctctgtctaccttcttggacttcattacctacagttatatgattgacaatattattctgttgattactggaacattgcatcaaagacctattggtgaactgattccaaaatgtcatccattaggcagctttgaacaaatggaagctatacacgtagccgcaacgccagcagagttatacaacgctgtcttagtagacacgccgctggctccattctttgtagattgcatcagcgaacaggatttggacgaaatgaacatcgaaatcatcagaaacactttgtacaaggcctacttggaagcgttctggactttttgcaaggcaatcggtggaaccacggctgattccatgtgcgaaattttggcgttcgaagctgatagacgagctatcatcattacgattaactctttcggtacggagcttagcaaggacgatagagctaaattgtatccacgttgcggaagactgcatcccgatgggttagctgctctggctagagctgaggattacgagcaggtcaaagctattgccgagtattatgctgagtattctaagctgtttgaaggcgccggaaacaatcccggcgataaaactttggaggataagttcttcgagtacgaggtgcgtctcaacatcaacgctttcatgcagcagttccactttggggtgttttattcatacttgaaactcaaggagcaggagtgcaggaatattgtatggatttccgagtgcgtggctcaaaaacacagagccaagattgataattacatccctattttctaa

SEQ ID NO: 654 - DNA, 1146 bp, Psylliodes chrysocephala; identical to SEQ ID NO: 653
  misc_feature: VATPase D

SEQ ID NO: 655 - DNA, 1146 bp, Psylliodes chrysocephala; identical to SEQ ID NO: 653
  misc_feature: VATPase D

SEQ ID NO: 656 - DNA, 1146 bp, Psylliodes chrysocephala; identical to SEQ ID NO: 653
  misc_feature: VATPase D

SEQ ID NO: 657 - DNA, 1146 bp, Psylliodes chrysocephala; identical to SEQ ID NO: 653
  misc_feature: VATPase D

SEQ ID NO: 658 - DNA, 1146 bp, Psylliodes chrysocephala; identical to SEQ ID NO: 653
  misc_feature: VATPase D

SEQ ID NO: 659 - DNA, 1146 bp, Psylliodes chrysocephala; identical to SEQ ID NO: 653
  misc_feature: VATPase D

SEQ ID NO: 660 - DNA, 1146 bp, Psylliodes chrysocephala; identical to SEQ ID NO: 653
  misc_feature: VATPase D

SEQ ID NO: 661 - DNA, 1146 bp, Psylliodes chrysocephala; identical to SEQ ID NO: 653
  misc_feature: VATPase D

SEQ ID NO: 662 - DNA, 972 bp, Psylliodes chrysocephala
  misc_feature: COPI Epsilon
aacaagaagatgaaaaattatttaaacgtcacacgtcacacaaacgtcataacaaaaatggcacgtcagcagcaagacgtagacgaacttttcgaaataaaaaattatttctatataggaaactaccagcaatgtatcaacgaagctcaaaaattaaaaaagccctcaactccagaagttgctacccaaagagatatcttcacttatagatcctacatggcacaaaataagtttttggtggtattagatgaaattcatggagcatctccgatcgaaattcaaccactgaaactattagctgattatctatcaggaaaaaataataaagaagcagtggtagcccaagttgaccaacaagtagccacaaatgccaataatgacactctgattttggttgctgccactatttacgtcaatgaaggcaatctggagggagcatataaagtattacatgcgtcagaatgtttggaagcacatgcttttattattgacattcttttgaagttggacagggtagatttggctaagaagaaattaaaagaaatgcaagataaagacgatgatgctactttaactcaactggcacaggcttggatcaacattcaaactggtggtgataaacttcaagatgcttactacatttaccaagaattggttgacaaatatggttcaacaccacttcttctgaacggtcaagctgtcacatttataggtcaagcaaaatatgaagaggcagaggcagctttgcaagaggctatcgataaagatgccaattatccagatacattggttaattttattacccttcagaggcatatgggcaaaggtcctgagattgcaaacagatatttatcccagttgaaggacgccaatcctgaacatccttacataaaggatttgaggcaaaaagaaagtgagtttcaaaggattactcaacaatattcgccatctgtaactagcattcctgcataa

SEQ ID NO: 663 - DNA, 972 bp, Psylliodes chrysocephala; identical to SEQ ID NO: 662
  misc_feature: COPI Epsilon

SEQ ID NO: 664 - DNA, 972 bp, Psylliodes chrysocephala; identical to SEQ ID NO: 662
  misc_feature: COPI Epsilon

SEQ ID NO: 665 - DNA, 972 bp, Psylliodes chrysocephala; identical to SEQ ID NO: 662
  misc_feature: COPI Epsilon

SEQ ID NO: 666 - DNA, 972 bp, Psylliodes chrysocephala; identical to SEQ ID NO: 662
  misc_feature: COPI Epsilon

SEQ ID NO: 667 - DNA, 972 bp, Psylliodes chrysocephala; identical to SEQ ID NO: 662
  misc_feature: COPI Epsilon

SEQ ID NO: 668 - DNA, 972 bp, Psylliodes chrysocephala; identical to SEQ ID NO: 662
  misc_feature: COPI Epsilon

SEQ ID NO: 669 - DNA, 972 bp, Psylliodes chrysocephala; identical to SEQ ID NO: 662
  misc_feature: COPI Epsilon

SEQ ID NO: 670 - DNA, 972 bp, Psylliodes chrysocephala; identical to SEQ ID NO: 662
  misc_feature: COPI Epsilon

SEQ ID NO: 671 - DNA, 972 bp, Psylliodes chrysocephala; identical to SEQ ID NO: 662
  misc_feature: COPI Epsilon

SEQ ID NO: 672 - DNA, 972 bp, Psylliodes chrysocephala; identical to SEQ ID NO: 662
  misc_feature: COPI Epsilon

SEQ ID NO: 673 - DNA, 1584 bp, Psylliodes chrysocephala
  misc_feature: COPI Delta
aataataatattttagtaaatttgtgccatttaaacgaaattacaatggtactaattgcagcagcagtctgcacgaaagcaggcaaaacaattgtatctagacagtttgttgaaatgaccaaagcacgtattgaaggtctactagctgctttcccaaagttaattccaactgggacacaacacacttttgttgaaacagattcagtgcgttacgtgtatcaacctttagaaagactatacatgttgctcatcacaactagagctagtaatatattagaagatctggagaccctacgtctatttgcaagagttattccagaatattgtaggtctttagatgaaaatgaaatagctgaaaatgccttttctcttatatttgcttttgatgaaattgtagctctaggttatagggaaagtgtcaatctgtctcaaatccgcacttttgtcgaaatggattcacatgaagaaaaagtttatcaagctgttagacagactcaagaaagagaggcaaagaacaagatgagagaaaaggctaaagaattgcaaaggcagaaaatggaagcacaaaagaagggtggcaaacctgcgttcagcaacagcggtggttttggtagttccaccggttatactccgacgccatctattggagatatcgctaaccaggtcaacgatgttaagccgccttcatatacagccacccctgcacaaaaacctcgtggtatgaaactaggcggaaagggtagagatgtggaatcttttgtggatcaattgaaatctgaaggagaaaacgtcataactccaaataaaaacagcatctcgcaaccaggaactaaagcacctgctattaaaactgatattgatgacgtccacttgagattggaagagaaactgatcgccagaatgggtcgtgatggaggagtgcaacaattcgaaatattaggcatggcgacgttgcacataggcgatgatagatggggcagaatacgagtccaattagaaaatcagaatgctcatggtgttcaactccaaacccatccaaatgtcgataaggagctattcaagttacgatcgcagattggtctgaagcagccctcaaagcctttccccatccacactgacgttggtgtgctaaaatggcgattgcagagcacagatgaagccttagtgcctctattaatcaactgttggccctcagaagctggcgacggcagttgtgacgtcaacatcgaatacgaacttgcccacatcaatttggaattggtcgatgtcaatattacaattccattgccaatcggttgctcgcccatagtaggcgaatgtgatggtacatacacacatgaagctaaaagaaatcatctggtttggaatttgccgcttattgacgctagtaacaagactgggtcgttagaattcaatgcaccgagagccattcccaatgatttcttcccgctgtcggtcggattcaattccaaatcatcctacgctagtattaagataaccgaagtagtccttgtcgatgatgattctcctattaaatattccgtggagactgcactctatccagaaaaatacgaagtagtgtaa

SEQ ID NO: 674 - DNA, 1584 bp, Psylliodes chrysocephala; identical to SEQ ID NO: 673
  misc_feature: COPI Delta

SEQ ID NO: 675 - DNA, 1584 bp, Psylliodes chrysocephala; identical to SEQ ID NO: 673
  misc_feature: COPI Delta

SEQ ID NO: 676 - DNA, 1584 bp, Psylliodes chrysocephala; identical to SEQ ID NO: 673
  misc_feature: COPI Delta

SEQ ID NO: 677 - DNA, 1584 bp, Psylliodes chrysocephala; identical to SEQ ID NO: 673
  misc_feature: COPI Delta

SEQ ID NO: 678 - DNA, 1584 bp, Psylliodes chrysocephala; identical to SEQ ID NO: 673
  misc_feature: COPI Delta

SEQ ID NO: 679 - DNA, 1584 bp, Psylliodes chrysocephala; identical to SEQ ID NO: 673
  misc_feature: COPI Delta

SEQ ID NO: 680 - DNA, 1584 bp, Psylliodes chrysocephala; identical to SEQ ID NO: 673
  misc_feature: COPI Delta

SEQ ID NO: 681 - DNA, 1584 bp, Psylliodes chrysocephala; identical to SEQ ID NO: 673
  misc_feature: COPI Delta

SEQ ID NO: 682 - DNA, 1191 bp, Psylliodes chrysocephala
  misc_feature: Rpn9
tttttgtcttgtcattcatattcacaaaaaatggctgcagctgcggtgcaaccgtctaatattagtgattatctatctaaaaaacaacaagaaagtccaaaagaattaggttccgaatgggccgaactcgaggaacttcataataaaaaattatggcatcaattaacattaaaattactcgtttttattaaaaaaccggaattacaaaaaggcgacaacctaattcaactttatcacaatttcattcaatccttcgaaaataaaatcaatcctttgtctttggttgaaatagcggctattgtcgtcgaacaatataaagaacctaaggatgcaatcactttcttagagaagactgaacctaaagttaaaatcaatccagatgcacaaaatctctgcaaagttttggagggccaaatttatctcgaaaagttaaacgatttagatgccaccaaaaagattatagaggaagtcgaagccactctagacaacgcagatggagttacacctgtgcatggcaggttttatttactggcctctcaatattatcgaattcaaggggaccatgcacaatattacagaactgccttgaggtatttgggttgcatagagctggacactttaaaatccgatgtcaaagtacaacatgcattttttttgggattggcagctctgttgggcgaaggtgtgtacaatcttggagaattactggctcaccctgtgttagactctttgaaatcaacagaaaatgcttggttaattgaacttttgtatgctttcaattctggtgacataaagagatttgaagctatgaaaacacaatgggctggcatagcagatctagctgctgaggagctctttttgagacaaaagatatctttgttgtgtctgatggagatgacctttagcagaccatctcacaacagacaactaacttttgctgaaatttcaaaagaaactaaattacctcttaatgaaattgaacttctggtcatgaaggcactttctcaaggtctcgttaaaggtgctattgatcaggttgccagtactgtaaatatgacatgggtccaacctagagttttggacaagactcaaatatccagcatggtatccagacttagtctgtggtgcacacatgtcaatactatggaacagttattagaagaaaaagcaagtgaaatattaactttgtag

SEQ ID NO: 683 - DNA, 1191 bp, Psylliodes chrysocephala; identical to SEQ ID NO: 682
  misc_feature: Rpn9

SEQ ID NO: 684 - DNA, 1191 bp, Psylliodes chrysocephala; identical to SEQ ID NO: 682
  misc_feature: Rpn9

SEQ ID NO: 685 - DNA, 1191 bp, Psylliodes chrysocephala; identical to SEQ ID NO: 682
  misc_feature: Rpn9

SEQ ID NO: 686 - DNA, 1191 bp, Psylliodes chrysocephala; identical to SEQ ID NO: 682
  misc_feature: Rpn9

SEQ ID NO: 687 - DNA, 1191 bp, Psylliodes chrysocephala; identical to SEQ ID NO: 682
  misc_feature: Rpn9

SEQ ID NO: 688 - DNA, 1191 bp, Psylliodes chrysocephala; identical to SEQ ID NO: 682
  misc_feature: Rpn9

SEQ ID NO: 689 - DNA, 1191 bp, Psylliodes chrysocephala; identical to SEQ ID NO: 682
  misc_feature: Rpn9

SEQ ID NO: 690 - DNA, 1191 bp, Psylliodes chrysocephala; identical to SEQ ID NO: 682
  misc_feature: Rpn9

SEQ ID NO: 691 - DNA, 1191 bp, Psylliodes chrysocephala; identical to SEQ ID NO: 682
  misc_feature: Rpn9

SEQ ID NO: 692 - DNA, 1191 bp, Psylliodes chrysocephala; identical to SEQ ID NO: 682
  misc_feature: Rpn9

SEQ ID NO: 693 - DNA, 690 bp, Psylliodes chrysocephala
  misc_feature: Vps24
agaaaaacatctgtaataaacatgggactttttgggaagacacctgaaaggaatcctaaagatttggttacagaatggaatcacaaacttcgcaaagagggataccaattagataggcaaattaaagctatacaaagagaagaggaaaaagtgaaaaggtctttaaaagatgcagcgaagaaaaacgacaaggacacctgccttattttggccaaggaaattattaattcaaggaaagctgttaataaaatttacacgtcgaaggctcacctcaattctgtgatgttgcaaatgaagaaccagttagctacattgagagtgtcaggcgccctccagaagtctacagaggtgatgcaagcgatgcagcgactcgttagagtgcccgaggtagcccaaacaatgcaagacatgtcgaaagagatgatgaaggcgggtataatcgaagaaatgttggacgaaaccatggaagaccttgattattccgaggaaatggaggaggcggcgcagacggagatcgacaaagttttgttcgagataacggagggaaagataggagaagcccctctgccgcctcaagacgccgcagagaaagtatcgccgttaccagcgacctctgtggaggaaccggaagaggaggacgaagaagagattacggaaatgcagagtcgattagcggcgctcaaatcctaa

SEQ ID NO: 694 - DNA, 690 bp, Psylliodes chrysocephala; identical to SEQ ID NO: 693
  misc_feature: Vps24

SEQ ID NO: 695 - DNA, 690 bp, Psylliodes chrysocephala; identical to SEQ ID NO: 693
  misc_feature: Vps24

SEQ ID NO: 696 - DNA, 690 bp, Psylliodes chrysocephala; identical to SEQ ID NO: 693
  misc_feature: Vps24

SEQ ID NO: 697 - DNA, 690 bp, Psylliodes chrysocephala; identical to SEQ ID NO: 693
  misc_feature: Vps24

SEQ ID NO: 698 - DNA, 690 bp, Psylliodes chrysocephala; identical to SEQ ID NO: 693
  misc_feature: Vps24

SEQ ID NO: 699 - DNA, 690 bp, Psylliodes chrysocephala; identical to SEQ ID NO: 693
  misc_feature: Vps24

SEQ ID NO: 700 - DNA, 2574 bp, Psylliodes chrysocephala
  misc_feature: Vps16A
atatattacaattattttcctttaatttttatcaaaatgtctgctgcaatgctaacggcagaatggttcttactgggaagagatgcatattacagaaaatttgaaatatattctatgtcatggcatcaagaagttaatatagagaattatatagcatcttcggcttcttacggaggccctatagccattagaagagatgaccaaaagattcttaaagtgcaggggtctggacaaccaattatttccattttttctggatctggcaaacagatagcttcattcaagtggagtagacggcccattgttcacatgggctggacaaatgatgaagaacttctttgtatacaagaagatggtatggtagtcaaacatgacatgtttggaaagtatcttcatacatttagcataagccaaaaggttcaagattccaaagttgttgatgctaaaatttttaccagtcctcaaaatttcactggcatcgctgtaatgacgtctaatttcaaaatatttgttgttaataacatcaatgatccaaaaacaagacaattgtctgaacttccaagatcaggaattcaacctactagctgggctatagtttctgatgataagactgaagttttaatagcaagaagtgtagaactctatagactgaaacaagatgaacaccacacaagtgcaatgcttgaaccggatatcaccaacaaatacacatcaatcataaaaatgtctgtttcattaaatgcacaccatctggcgttgtttacggattctggatttttgtggttgggttccacaaatttgaggacaaaatactgcgaaatcgattgtgacatggtttttagaccaaaacatttactttggtgtggtaatgaggctgttgttctgtattgggaaaaagacaacacttttttaatagttggtaaacacggtcaaaaattaagttacttttatgatggatcggttcatttggtaccagaaatagatggtattaggataatttcgaatacgcaacatgaactacttcaaaaagtaccagaagttgttcaaaagatttttagaattaacagcacagaccctggtagttttctgttagaagcctcaaaacaatttcaaaaaggtagccataaagcaaatgaatacatttgtttagttaaaaatgatctggagactgcagtcaaccagtgtatagaagcagtaggatatgaatttgacactgacgttcaaaaattgttaataagagcagcacaatttggtaaatgcttcattccagacatgagatctgatagttatgtaaatatgtgtagacttttgagagtattgaatgctgtcagagaccccaaagtggggatacccattactattacacagttaaattacatgaaaagaaggaagcaagacatactgaagcggcttataacaaggaattattattatttggctttacaaattgccaaatacttgaaattaccagaggaagacggaacaagctatattttggtccactgggcaaaatataaggtcagccagtcacatttagaggaagaaacggtagctagggaaattgctgaaaagttggggtactcttcaggcatttcttacagtgaaattgccagtactgcttcagaatatgggagaaaaaaattggctataaagcttctagattacgagtctaaagcaagcgaccaagtaaaactgcttttagaattaggagaaaacgtaccagcgttagttaaggcgattgaaagtggagatacagatttagtgtatatggttatattgaaattaagagaaaatatgccgttgggagactttaagatgactattagaaattttcctgtagctcaatccctgtttattaaatactgcaaagagcataatacccaagctttaagtgaaatatacattcaagaagatgatttctgcgcccaagccgagatgtttatccttgacagtttagacgataagaaaaatcacatgaaagacgcccttctcacctcggcattggaggcttacaaaaaaggtcgcaaagatttatatgtctcaatgtgcgacgaatcaataaaattaattcgtttccaacgagacgtagaggataaagtaccaaacgcaaaaaataaatttatcggaaaatccgtacaagatacttgcaaaacattgctagaaatgaaagagacgaaattggccgagaagtttaaaaacgatttcaaaatacccgatagaagatactggtggttgaaaataaacagtttggccaaacacaacgattggatcgagttggaaaaattctcgaaattaaagaaatcccctataggatatgcgccgtttgtggacgtttgtttgcagcacgataaacgccaggaagctctcaaatatttacctaaagttagcgaggacataaaggttaaatattgcatcaaagcagcgtgcttagaagaagcagcagatatagcttaccatcagagagacatgcagagtcttctgtatgtccaaagcaaatgtggaaaccaatttgctcagaatcaattagctgaaaaaataaatacaatgataatgcagctggattctaaaaaataa

SEQ ID NO: 701 - DNA, 2574 bp, Psylliodes chrysocephala; identical to SEQ ID NO: 700
  misc_feature: Vps16A

SEQ ID NO: 702 - DNA, 2574 bp, Psylliodes chrysocephala; identical to SEQ ID NO: 700
  misc_feature: Vps16A

SEQ ID NO: 703 - DNA, 2574 bp, Psylliodes chrysocephala; identical to SEQ ID NO: 700
  misc_feature: Vps16A

SEQ ID NO: 704 - DNA, 2574 bp, Psylliodes chrysocephala; identical to SEQ ID NO: 700
  misc_feature: Vps16A

SEQ ID NO: 705 - DNA, 2574 bp, Psylliodes chrysocephala; identical to SEQ ID NO: 700
  misc_feature: Vps16A

SEQ ID NO: 706 - DNA, 2574 bp, Psylliodes chrysocephala; identical to SEQ ID NO: 700
  misc_feature: Vps16A

SEQ ID NO: 707 - DNA, 2574 bp, Psylliodes chrysocephala; identical to SEQ ID NO: 700
  misc_feature: Vps16A

SEQ ID NO: 708 - DNA, 2574 bp, Psylliodes chrysocephala; identical to SEQ ID NO: 700
  misc_feature: Vps16A

SEQ ID NO: 709 - DNA, 2574 bp, Psylliodes chrysocephala; identical to SEQ ID NO: 700
  misc_feature: Vps16A

SEQ ID NO: 710 - DNA, 2574 bp, Psylliodes chrysocephala; identical to SEQ ID NO: 700
  misc_feature: Vps16A

SEQ ID NO: 711 - DNA, 414 bp, Psylliodes chrysocephala
  misc_feature: RpL40
gcacgttgcggaacaccaccttccacaatgcaaattttcgtgaaaactctcacaggtaaaaccattaccctcgaggtagagccatcagatactatagaaaatgtaaaagcaaagatccaggacaaggaaggtatccctcctgaccagcagcgattaatcttcgctggaaaacaactcgaagatggacgtactctttcagactataatatccagaaagaatccacccttcatttggtgctccgtttgagaggaggtatcatcgagccctctctgcgtctcctagctcagaaatacaactgcgacaagatgatctgtcgcaaatgctatgctaggttacaccctagggctactaattgcaggaaaaccaagtgtggacacacaaacaacttgcgccccaagaagaagctgaagtaa

SEQ ID NO: 712 - DNA, 414 bp, Psylliodes chrysocephala; identical to SEQ ID NO: 711
  misc_feature: RpL40

SEQ ID NO: 713 - DNA, 414 bp, Psylliodes chrysocephala; identical to SEQ ID NO: 711
  misc_feature: RpL40

SEQ ID NO: 714 - DNA, 1254 bp, Psylliodes chrysocephala
  misc_feature: RpL3
ttctactttgagatgtctcacagaaagttcagtgcaccacgtcacggatctatggggttctaccccaagaaaaggtcgcaaaggcatcgtggaaaggtaaaggctttccctaaggatgatccctcgaaacctgtccatttaaccgcttttatcggttataaagctggtatgacccacgttgtaagagaagcagacaggcccggttcaaaaataaataagaaagaaatcgtagaggctgttaccattttggaaactcctccaatggttgttgtaggagtagttggttatattgaaactccacatggtcttagggctttggccacagtttgggctgagcatttatctgaagactgtcgcagacgcttctacaagaactggtacaagagcaaaaagaaggccttcactaaggcatctaagaaatggactgatgatctaggtaagaagtccattgaacgcgacttgaagaagatcattaagtactgcaaggttgtcagggtggttgctcacactcagatgaaattgttgaaacaacgtcaaaagaaagcccacatcatggaaattcaacttaacggtggaaccgtagccgataaggttgcatgggccagggaacatcttgaaaaaccaatccctgttgccaacgtctttgcccaagatgagatgattgactgcattggtgtcaccaagggtcatggatacaaaggtgttacttctcgttggcacacaaagaagttgccccgcaaaacgcacaagggtcttcgtaaagttgcttgtattggagcgtggcatccttctcgtgtatcgttcaccgtagcccgtgctggtcagaaaggttaccatcacagaactgagatgaacaagaagatttacagaatcggagccggaatccacaccaaagatggaaaggtcgtcaagaacaatgcttccactgcttatgatcttagtgagaaaaccattactccaatgggaggtttccctcactatggtgaagtgaacaatgacttcgtcatgatcaagggatgttgtataggacccaagaagcgtgtcatcaccctcagaaagtccttgttggtccacaccaaacgtgtcgctttggagaagatcaatttgaaattcattgatacctcgtctaaatttggacacggtagattccagaccgccgccgataaggccgccttcatgggtccgctcaagaaggatagagttaaggaagaagataagaccgccgcacccgctgcggcagcagtttccagttag

SEQ ID NO: 715 - DNA, 1254 bp, Psylliodes chrysocephala; identical to SEQ ID NO: 714
  misc_feature: RpL3

SEQ ID NO: 716 - DNA, 1254 bp, Psylliodes chrysocephala; identical to SEQ ID NO: 714
  misc_feature: RpL3

SEQ ID NO: 717 - DNA, 1254 bp, Psylliodes chrysocephala; identical to SEQ ID NO: 714
  misc_feature: RpL3

SEQ ID NO: 718 - DNA, 1254 bp, Psylliodes chrysocephala; identical to SEQ ID NO: 714
  misc_feature: RpL3

SEQ ID NO: 719 - DNA, 1254 bp, Psylliodes chrysocephala; identical to SEQ ID NO: 714
  misc_feature: RpL3

SEQ ID NO: 720 - DNA, 1254 bp, Psylliodes chrysocephala; identical to SEQ ID NO: 714
  misc_feature: RpL3

SEQ ID NO: 721 - DNA, 1254 bp, Psylliodes chrysocephala; identical to SEQ ID NO: 714
  misc_feature: RpL3

SEQ ID NO: 722 - DNA, 1254 bp, Psylliodes chrysocephala; identical to SEQ ID NO: 714
  misc_feature: RpL3

SEQ ID NO: 723 - DNA, 1254 bp, Psylliodes chrysocephala; identical to SEQ ID NO: 714
  misc_feature: RpL3

SEQ ID NO: 724 - DNA, 1254 bp, Psylliodes chrysocephala; identical to SEQ ID NO: 714
  misc_feature: RpL3

SEQ ID NO: 725 - DNA, 1317 bp, Psylliodes chrysocephala
  misc_feature: Vps4
gttcaaatggctacgggaactactttacaaaaagctatagaactagtaactaaagccaccgaagaggataggaataaaaattatgaagaagctcttcgtttgtatgaacatggtgtagaatattttcttcatgccataaagtatgaagctcagggagaaaaggctaaggaaagtattagggctaagtgtgtacaatatctagaaagggctgaaaaaattaaagaatctataaggaaaactaaaaagaagccagtattagatggaggctcctccaaagaagacaaaaagagtgatagtgatgaagatgacgatcctgataaaaagaagctacaaagcaaactagaaggtgctatagttgttgaaaaacctcacgtgaaatggacagatgtagctggattggaagctgctaaagaagcccttaaggaagctgtaattttaccaatcaagtttccacatcttttcagtggaaagagagtaccttggaaaggtattttgttgtttgggccacctggtactggtaaatcttatttagccaaagctgttgcgaccgaagccaataattccactttcttctcggtgtcctcttctgatttagtctcaaaatggttgggtgaatctgagaaattggtcaagaacttgttcgagttggccagaactcacaaacccagcatcatattcattgacgaaatcgattcactttgttcgtcacgttctgataatgaatctgaatcagccaggagaatcaagacggaatttttagttcaaatgcaaggtgttggccatgataccgagggtatcttagtgttaggagctactaatattccttgggtattagattccgccatcaggagacgtttcgaaaaaaggatttacataccgctaccggaagaaccggcgagagctgtcatgttcaaattacatttaggaaatacccacacagagttgacagaagaagacatcaaagagttggcttccaaaactgaaggttactctggtgctgatattagtatcgtggtacgtgacgctctgatgcagccagtgcgtaaagttcaaaccgcgacccactttaagaggattaggggaccatcaccagtcgatcccaataccatagtggatgatttactcataccttgctcgcccggtgattctggtgcaatagaaatgtcctggatggatattccgagcgaaaaattagcagagccaccggttactttgaatgacatgttgagatcagttggcacctcgaagcccaccgtcaatgatgaggatcttacgaaattgaggaagtttatggaagatttcggacaagaaggatag

SEQ ID NO: 726 - DNA, 1317 bp, Psylliodes chrysocephala; identical to SEQ ID NO: 725
  misc_feature: Vps4

SEQ ID NO: 727 - DNA, 1317 bp, Psylliodes chrysocephala; identical to SEQ ID NO: 725
  misc_feature: Vps4

SEQ ID NO: 728 - DNA, 1317 bp, Psylliodes chrysocephala; identical to SEQ ID NO: 725
  misc_feature: Vps4

SEQ ID NO: 729 - DNA, 1317 bp, Psylliodes chrysocephala; identical to SEQ ID NO: 725
  misc_feature: Vps4

SEQ ID NO: 730 - DNA, 1872 bp, Psylliodes chrysocephala
  misc_feature: VATP-A/Vha68-2
ggttgcaatagatacataacatccacaaaaatgtctagagtccgggttggagacgaagaaaaagagggccagtatggatatgtccatgccgtgtccggtccagtcgtcactgctgaaaaaatgtctggatctgctatgtacgaattagtacgtgtagggtactatgagcttgtaggagaaattattcgattggagggtgatatggcaactatccaggtatatgaagaaacttctggtgtaacagtcggcgaccctgtattgagaaccggcaaacctctatcagtagaacttggacctggtattatgggttccatttttgatggtattcaacgtcctctaaaggacattaacgacttaactcaaagtatttacattccgaaaggtgtaaatgttccagcactttccagaacggcaaagtgggaattcgcacccatcaacatcaagttgggatctcatttgaccggcggtgacatctatggtatggttcatgaaaacactcttgtgaagcttaaaatgactcttccacctaaagctaagggaactgtaacatatgttgcagacccaggaaattacacagttgatgaagttgtattggaaactgaatttgatggagaacgcacaaaatacaccatgttgcaagtgtggccggtacgtcaagccagacctgttagtgaaaaattgccggccaatcatcccctacttaccggacaacgtgtattggatgccctcttcccttgtgttcagggcggtactactgctattcccggtgcctttggttgtggaaaaactgtaatttcacagtcgctctccaaatactccaattctgatgtcattgtctacgtaggttgtggagaaagaggtaatgaaatgtctgaagtattgcgggacttccctgaattgacggtagaaatcgacggcgcgaccgaatctatcatgaaacgtaccgccttagtagccaacacttcaaacatgcccgtagccgcccgtgaggcctccatctatacgggtatcacgctatcagagtacttccgtgatatgggttacaatgtatccatgatggccgattccacctcccgttgggccgaagccttgagagaaatttcaggtcgtttggccgagatgcccgccgattccggttatccggcctatttgggagcccgtttggcctctttctacgaacgtgctggtcgcgttaagtgtttgggtaatcccgacagggagggttccgtgtccatcgtcggcgctgtgtctccccctggtggtgacttttcagatcccgtcacatctgctactcttggtatcgtacaagtattttggggtttggataagaaacttgcacaacgtaagcacttcccctctgtcgattggctcagttcatattccaaatatttgagggcattggacgatttctatgacaaaaactttgccgaattcataccccttagaactaaagttaaggaaattcttcaggaagaagacgatctcacagaaatcgtgcaactagtaggaaaagcatcgttggccgaagctgacaaaatcactttggaaatcgccaagctgttgaaagaagatttcctccaacaaaactcctactcgtcctacgatcgtttttgcccgttctacaaaaccgtcggaatgctcaagaacatgatcggcatgtacgacatggctagacacgccgtagaatcgacggctcagtccgagaacaagatcacgtggaacgtgatcagggattcgatgagcaacattttgtaccaattgagcagtatgaagtttaaagatcccgttaaagacggcgaagcgaaaatcaaagccgattttgaccagctgtatgaagatatccaacaggcattcagaaatctagaagattaa

SEQ ID NO: 731 - DNA, 1872 bp, Psylliodes chrysocephala; identical to SEQ ID NO: 730
  misc_feature: VATP-A/Vha68-2

SEQ ID NO: 732 - DNA, 1872 bp, Psylliodes chrysocephala; identical to SEQ ID NO: 730
  misc_feature: VATP-A/Vha68-2

SEQ ID NO: 733 - DNA, 1872 bp, Psylliodes chrysocephala; identical to SEQ ID NO: 730
  misc_feature: VATP-A/Vha68-2

SEQ ID NO: 734 - DNA, 1872 bp, Psylliodes chrysocephala; identical to SEQ ID NO: 730
  misc_feature: VATP-A/Vha68-2

SEQ ID NO: 735 - DNA, 1872 bp, Psylliodes chrysocephala; identical to SEQ ID NO: 730
  misc_feature: VATP-A/Vha68-2

SEQ ID NO: 736 - DNA, 1872 bp, Psylliodes chrysocephala; identical to SEQ ID NO: 730
  misc_feature: VATP-A/Vha68-2

SEQ ID NO: 737 - DNA, 1872 bp, Psylliodes chrysocephala; identical to SEQ ID NO: 730
  misc_feature: VATP-A/Vha68-2

SEQ ID NO: 738 - DNA, 1872 bp, Psylliodes chrysocephala; identical to SEQ ID NO: 730
  misc_feature: VATP-A/Vha68-2

SEQ ID NO: 739 - DNA, 1872 bp, Psylliodes chrysocephala; identical to SEQ ID NO: 730
  misc_feature: VATP-A/Vha68-2

SEQ ID NO: 740 - DNA, 1872 bp, Psylliodes chrysocephala; identical to SEQ ID NO: 730
  misc_feature: VATP-A/Vha68-2

SEQ ID NO: 741 - DNA, 2244 bp, Psylliodes chrysocephala
  misc_feature: sec6
cagcaatattatttaaaaatgggtgcaaaaaaagtaaatatgagagagctagaagcagctgctaaagcgtctgctactactaaagtgataaatacattgaataggccaggacaattagaaaaaattgaccaaataaaacaacgatatgttcgaaaaaaagcttcagttgaagcattgctgaagtcagcaatgcagcaacagctagatggtgttagaattggtttgaatcaactacacaggtgtctcgaagaagtatctgaaattaatattagtatgaaaaagatgtcagacttattttctgatgtaccagagcttagtaaggtactctgtgatattagagatgaaaatatgaggcattcgcaatatgtaacagccaaagaaaatctgaaacatatttttacagtcccagaaagtgtagaaaagacaaaatcctggattaatgaaggaaagttacttcatacacatcagtgcttgagagacttggaaaattcaagagatgacttactatttgagcttcacaaattacctaaccaatctgtacatgataaatcaatgttaaaagcatattttgctgatgtagaagtactatccagcttactagaaaaacagttaactattattttatatagaacattaaatactgtaagaaaagatcctacagtaatagttactgcattgagaattattgaaagggaggaaaaagcagatgaagaagctctgaaacaacagagacaaactgggtttatccctcctggtcgtcctaaaaagtggaaagagatggcttttagcattattgagaaaacagtatcttcaaaaattgaaggtactcaagttgaggaaagagaagataataaacactggctgataagatatttagaacttattagaatgatgattttagaagatttaagaattgtcaaaactctttgcttaccgtgctttcctccaagttataaaatattagataaatatattcatatctaccatggatgcctttccgtacatctgcaggaaattatacaaaatggccttcaaggtaatgaatatgttacaatgctgtcttgggttcttaaaacttatcgagccaaagacatgttaggtcaccctgatttagtgacctctactgaaaatttacctcctttacttccatctgctgttatagacagattagaagaagactatcttaagaatattgaagcgaactatagtgaatggatgcaaaatactcttaaatcagaaaaagaggaatggaggatgaatactgaaccttattcagagtcatattctcgtacgccagccccaattattatttttcaaatgatagatcagaatttacaagtaaccaaaacaataagtgaagagctaacatttaaatgcttgaatttaagcattagacaagttataatattcgcagatgctttcagggatgctattattgaatttaagaacaaatattttgaggacaggaaacaagtcgtttatttcacccagtatatgattttaatagtaaataatactttacaacttgtggagttggggtgtcaattagaaaaacagtatgttactaataacagttcacatgaacttaccaagaattttggcatgttaaaaagtacttatattaaattgaggaatgacgcagtcatgtacttgctagaagaactttttgtagacatagaccaacattttgataaattgttcacatcacattggttcccaactaaccctgccgacacaatctatgttacaatagaagattatttccaagattacaaccgattagctgaagcgaactacaaatatgcagtggaattattattaaccctagtgggtagaaaatatcttacagctatgctgtctaggcgcatatctttcaaaactttcgatgaatgcatgaaagctgcccaaaaagtttcggaagaagccaatagattcaacaaactctttgaaaatctcagtaatgatatagaatgcgagaacccatttgatgccatcattatgctctctgaagtgctgaaaagcgatgatgacatgttatcctttgagctacatagggtggttgaaaagtatcctgatattactgatgatcatcttttaagactgctgaacctgagaggagacctgtcaagatcagatgtcagagataaagttgtgcatgtagataagcctaaagttctgcataagagcacagtgtttaagaccctggtgtttcctaagcttgtaaatattaatttaactttctag

SEQ ID NO: 742 - DNA, 2244 bp, Psylliodes chrysocephala; identical to SEQ ID NO: 741
  misc_feature: sec6

SEQ ID NO: 743 - DNA, 2244 bp, Psylliodes chrysocephala; identical to SEQ ID NO: 741
  misc_feature: sec6

SEQ ID NO: 744 - DNA, 2244 bp, Psylliodes chrysocephala; identical to SEQ ID NO: 741
  misc_feature: sec6

SEQ ID NO: 745 - DNA, 2244 bp, Psylliodes chrysocephala; identical to SEQ ID NO: 741
  misc_feature: sec6

SEQ ID NO: 746 - DNA, 2244 bp, Psylliodes chrysocephala; identical to SEQ ID NO: 741
  misc_feature: sec6

SEQ ID NO: 747 - DNA, 2244 bp, Psylliodes chrysocephala; identical to SEQ ID NO: 741
  misc_feature: sec6

SEQ ID NO: 748 - DNA, 2244 bp, Psylliodes chrysocephala; identical to SEQ ID NO: 741
  misc_feature: sec6

SEQ ID NO: 749 - DNA, 2244 bp, Psylliodes chrysocephala; identical to SEQ ID NO: 741
  misc_feature: sec6

SEQ ID NO: 750 - DNA, 2244 bp, Psylliodes chrysocephala; identical to SEQ ID NO: 741
  misc_feature: sec6

SEQ ID NO: 751 - DNA, 2244 bp, Psylliodes chrysocephala; identical to SEQ ID NO: 741
  misc_feature: sec6

SEQ ID NO: 752 - DNA, 2244 bp, Psylliodes chrysocephala; identical to SEQ ID NO: 741
  misc_feature: Rpn3

SEQ ID NO: 753 - DNA, 2244 bp, Psylliodes chrysocephala; identical to SEQ ID NO: 741
  misc_feature: Rpn3

SEQ ID NO: 754 - DNA, 2244 bp, Psylliodes chrysocephala; identical to SEQ ID NO: 741
  misc_feature: Rpn3

SEQ ID NO: 755 - DNA, 2244 bp, Psylliodes chrysocephala; identical to SEQ ID NO: 741
  misc_feature: Rpn3

SEQ ID NO: 756 - DNA, 2244 bp, Psylliodes chrysocephala; identical to SEQ ID NO: 741
  misc_feature: Rpn3

SEQ ID NO: 757 - DNA, 2244 bp, Psylliodes chrysocephala; identical to SEQ ID NO: 741
  misc_feature: Rpn3

SEQ ID NO: 758 - DNA, 2244 bp, Psylliodes chrysocephala; identical to SEQ ID NO: 741
  misc_feature: Rpn3

SEQ ID NO: 759 - DNA, 2244 bp, Psylliodes chrysocephala; identical to SEQ ID NO: 741
  misc_feature: Rpn3

SEQ ID NO: 760 - DNA, 2244 bp, Psylliodes chrysocephala; identical to SEQ ID NO: 741
  misc_feature: Rpn3

SEQ ID NO: 761 - DNA, 2244 bp, Psylliodes chrysocephala; identical to SEQ ID NO: 741
  misc_feature: Rpn3

SEQ ID NO: 762 - DNA, 2244 bp, Psylliodes chrysocephala; identical to SEQ ID NO: 741
  misc_feature: Rpn3

SEQ ID NO: 763 - DNA, 1533 bp, Psylliodes chrysocephala
  misc_feature: VATPase B
gtttttgtggtttgtgacagacgtatctttccttcagagaagatgtcttacccttcgacgttaaatgcaaaacaggcctcacgggaacatattttggctgtttccagagattttgtatctcagcccagactcacttataaaacggtatctggtgtcaatggtccactggtaattctggaagatgtaaagttcccaaaattcaacgaaattgtccaacttagattggctgatggaactttaagatctggtcaagttttggaagtcagtgggaataaagctgtagtacaagtatttgaaggcacctcaggaattgatgccaaaaacacagtatgtgaattcactggtgatattctcagaactccagtatctgaggatatgttgggtagagtgttcaacggatctggaaaaccaattgataaaggtcccccaattttggcagaagattacttagatatccaaggtcaacctatcaacccatggtcacgtatttatcctgaagaaatgatccaaactggtatctccgccatcgacgtaatgaactccattgcccgtggccaaaaaattcccattttctcggccgctggtctgcctcacaacgaaattgctgctcaaatttgtcgacaagccggtcttgtcaaaattcccggcaaatctgtattggatgaccatgaagataactttgctattgtgtttgctgctatgggagttaacatggaaactgctaggtttttcaaacaagatttcgaagaaaatggttccatggaaaatgtatgtctgtttttgaacttggctaatgatcccactattgaaagaattattacaccacgtttggctcttacagcagctgaatttttggcctaccaatgcgaaaaacacgtcctggtcatattgactgatatgtcttcatatgctgaagctttgcgtgaggtatccgccgccagagaagaagtgcccggtcgtcgtggtttcccaggttacatgtacaccgatttggccaccatttacgaacgtgccggtcgtgtcgaaggtcgtaacggttccattacgcagattcccatcttgactatgcctaacgacgatattacccatccaattcccgatttgacaggttatattaccgagggacagatctacgtagaccgtcaattgcacaataggcaaatctatcctccagtcaatgtattgccctctttgtctcgtttgatgaaatccgccattggtgagggtatgaccaggaaagatcactctgacgtttctaaccaactgtatgcctgttacgctatcggtaaggatgtccaagctatgaaagccgtagtaggagaggaagctcttacacctgacgatctcctgtacttggaattcttaacgaaattcgaaaagaacttcatcactcagggtaactacgaaaaccgtaccgttttcgaatcattggacatcggttggcaactactccgtatcttccccaaggaaatgttgaaacgtatcccagccagtatattggccgaattctatcccagagactcgcgtcattag

SEQ ID NO: 764 - DNA, 1533 bp, Psylliodes chrysocephala; identical to SEQ ID NO: 763
  misc_feature: VATPase B

SEQ ID NO: 765 - DNA, 1533 bp, Psylliodes chrysocephala; identical to SEQ ID NO: 763
  misc_feature: VATPase B

SEQ ID NO: 766 - DNA, 1533 bp, Psylliodes chrysocephala; identical to SEQ ID NO: 763
  misc_feature: VATPase B

SEQ ID NO: 767 - DNA, 1533 bp, Psylliodes chrysocephala; identical to SEQ ID NO: 763
  misc_feature: VATPase B

SEQ ID NO: 768 - DNA, 1533 bp, Psylliodes chrysocephala; identical to SEQ ID NO: 763
  misc_feature: VATPase B

SEQ ID NO: 769 - DNA, 1533 bp, Psylliodes chrysocephala; identical to SEQ ID NO: 763
  misc_feature: VATPase B

SEQ ID NO: 770 - DNA, 1533 bp, Psylliodes chrysocephala; identical to SEQ ID NO: 763
  misc_feature: VATPase B

SEQ ID NO: 771 - DNA, 1533 bp, Psylliodes chrysocephala; identical to SEQ ID NO: 763
  misc_feature: VATPase B

SEQ ID NO: 772 - DNA, 717 bp, Psylliodes chrysocephala
  misc_feature: Proteasome alpha 2
tcattagaaataatggcatccgaacgttatagtttttctttaactacttttagcccttccggtaaattagttcaaattgaatatgccttagcggctgtagcggcaggcgcaccatcagtaggaattaaagcatgtaatggagttgtaatagctacagaaaacaaacataaatcaattctttatgatgaacacagcgttcacaaagttgaaatgattaccaaacacattggaatggtttattctggcatgggaccagattaccgtttgctagtaaaacaagcgcgtaaaatggcccaacaatattaccttgtgtatcaggaacctattcctacagtgcaattggttcagagagtagcagcagtaatgcaagagtatacccaatctggaggtgtcagaccttttggtgtttctttattgatctgtggatgggacaataataggccttatttattccagtgtgatccttctggagcctattttgcttggaaagctactgctatgggcaaaaattatgttaatgggaaaactttcttggaaaaaaggtacagtgaagaattggaattagacgatgctgtacacactgcaattttaacattaaaagaaagtttcgagggccagatgacagctgataacattgaagttggaatttgcgatgaatcaggtttcagaaggttcgatccttctacagtgaaggactttttggcaaatatcccttaa

SEQ ID NO: 773 - DNA, 717 bp, Psylliodes chrysocephala; identical to SEQ ID NO: 772
  misc_feature: Proteasome alpha 2

SEQ ID NO: 774 - DNA, 717 bp, Psylliodes chrysocephala; identical to SEQ ID NO: 772
  misc_feature: Proteasome alpha 2

SEQ ID NO: 775 - DNA, 717 bp, Psylliodes chrysocephala; identical to SEQ ID NO: 772
  misc_feature: Proteasome alpha 2

SEQ ID NO: 776 - DNA, 717 bp, Psylliodes chrysocephala; identical to SEQ ID NO: 772
  misc_feature: Proteasome alpha 2

SEQ ID NO: 777 - DNA, 717 bp, Psylliodes chrysocephala; identical to SEQ ID NO: 772
  misc_feature: Proteasome alpha 2

SEQ ID NO: 778 - DNA, 717 bp, Psylliodes chrysocephala; identical to SEQ ID NO: 772
  misc_feature: Proteasome alpha 2

SEQ ID NO: 779 - DNA, 717 bp, Psylliodes chrysocephala; identical to SEQ ID NO: 772
  misc_feature: Proteasome alpha 2

SEQ ID NO: 780 - DNA, 717 bp, Psylliodes chrysocephala; identical to SEQ ID NO: 772
  misc_feature: Proteasome alpha 2

SEQ ID NO: 781 - DNA, 717 bp, Psylliodes chrysocephala; identical to SEQ ID NO: 772
  misc_feature: Proteasome alpha 2

SEQ ID NO: 782 - DNA, 717 bp, Psylliodes chrysocephala; identical to SEQ ID NO: 772
  misc_feature: Proteasome alpha 2

SEQ ID NO: 783 - DNA, 642 bp, Psylliodes chrysocephala
  misc_feature: Vps20
gatctcgacatgggtataatattcggcaaaaagaaaaagcccagtagagttactgaacaagacaaagcaatattacaactaaaacagcaaagagacaaactaaaacagtatcaaagaagaatagaactatctcttgttaaagacaaggaattagctaagaaactattaaacaatggccaaaaagaaagagcaaaactgctcctcaaaaagaaacgataccaagaacagattctgtccaaactagatggtcaactaagcaacttagaaagtatggctagtgatatagaatttgcccaagttgaagtacaggtagtagaaggtcttaaaacaggaaatgaagctctgaaaaaagtcaatgctgctctaaatattgaagatattgaacgtatattagacgaaacaagagagggagtagacaaacaaaatgaaatcaatgaactgcttagtggccagttgactgatgaagatgaggctgctgtagaggacgaactagcagctattattagtgaagagatgcctgcagtgccttctcaagagcctgaagtacaggccaatgaatctgccgaggaggatgaaaaagatcaggagattgtcaaaaagccaaaagagaaagaaaaagagaacattcctgttttggcttaa

SEQ ID NO: 784 - DNA, 642 bp, Psylliodes chrysocephala; identical to SEQ ID NO: 783
  misc_feature: Vps20

SEQ ID NO: 785 - DNA, 642 bp, Psylliodes chrysocephala; identical to SEQ ID NO: 783
  misc_feature: Vps20

SEQ ID NO: 786 - DNA, 642 bp, Psylliodes chrysocephala; identical to SEQ ID NO: 783
  misc_feature: Vps20

SEQ ID NO: 787 - DNA, 642 bp, Psylliodes chrysocephala; identical to SEQ ID NO: 783
  misc_feature: Vps20

SEQ ID NO: 788 - DNA, 642 bp, Psylliodes chrysocephala; identical to SEQ ID NO: 783
  misc_feature: Vps20

SEQ ID NO: 789 - DNA, 642 bp, Psylliodes chrysocephala; identical to SEQ ID NO: 783
  misc_feature: Vps20

SEQ ID NO: 790 - DNA, 642 bp, Psylliodes chrysocephala; identical to SEQ ID NO: 783
  misc_feature: Vps20

SEQ ID NO: 791 - DNA, 602 bp, Psylliodes chrysocephala
  misc_feature: RpL19
caatgagttccttaaaacttcaaaagaggctggcagcctctgttatgagatgtggtaagaagaaagtatggttggatcctaatgaaatcaatgagattgccaatacaaattccagacaaaatattcgtaaattgatcaaggatggtcttattattaagaaacctgtagcggtacattcacgtgcccgcgtacgtaagaacaccgaagctcgtagaaaggggaggcactgcggttttggtaaaaggaaaggtactgctaatgcccgtacaccccaaaaggaattatggatccagcgcatgcgcgttttgcgtcgattattaaaaaaatatcgggaagcgaaaaagattgacagacatctataccactcactgtacatgaaggctaagggtaatgtattcaagaacaaacgtgttcttatggaatacattcacaaaaagaaggctgagaaggcacgtgctaagatgttagcagatcaagctaatgccaggagaatgaaggtgaaacaagctagagaaagacgggaagaacgtattgctacaaagaagcaagaagtgttgcagaactaccagagggaagatgaagcagcagccgctaagaaataa

SEQ ID NO: 792 - DNA, 602 bp, Psylliodes chrysocephala; identical to SEQ ID NO: 791
  misc_feature: RpL19

SEQ ID NO: 793 - DNA, 602 bp, Psylliodes chrysocephala; identical to SEQ ID NO: 791
  misc_feature: RpL19

SEQ ID NO: 794 - DNA, 602 bp, Psylliodes chrysocephala; identical to SEQ ID NO: 791
  misc_feature: RpL19

SEQ ID NO: 795 - DNA, 602 bp, Psylliodes chrysocephala; identical to SEQ ID NO: 791
  misc_feature: Rpt6

SEQ ID NO: 796 - DNA, 602 bp, Psylliodes chrysocephala; identical to SEQ ID NO: 791
  misc_feature: Rpt6

SEQ ID NO: 797 - DNA, 602 bp, Psylliodes chrysocephala; identical to SEQ ID NO: 791
  misc_feature: Rpt6

SEQ ID NO: 798 - DNA, 602 bp, Psylliodes chrysocephala; identical to SEQ ID NO: 791
  misc_feature: Rpt6

SEQ ID NO: 799 - DNA, 602 bp, Psylliodes chrysocephala; identical to SEQ ID NO: 791
  misc_feature: Rpt6

SEQ ID NO: 800 - DNA, 602 bp, Psylliodes chrysocephala; identical to SEQ ID NO: 791
  misc_feature: Rpt6

SEQ ID NO: 801 - DNA, 602 bp, Psylliodes chrysocephala; identical to SEQ ID NO: 791
  misc_feature: Rpt6

SEQ ID NO: 802 - DNA, 602 bp, Psylliodes chrysocephala; identical to SEQ ID NO: 791
  misc_feature: Rpt6

SEQ ID NO: 803 - DNA, 602 bp, Psylliodes chrysocephala; identical to SEQ ID NO: 791
  misc_feature: Rpt6

SEQ ID NO: 804 - DNA, 602 bp, Psylliodes chrysocephala; identical to SEQ ID NO: 791
  misc_feature: Rpt6

SEQ ID NO: 805 - DNA, 602 bp, Psylliodes chrysocephala; identical to SEQ ID NO: 791
  misc_feature: Rpt6

SEQ ID NO: 806 - DNA, 602 bp, Psylliodes chrysocephala; identical to SEQ ID NO: 791
  misc_feature: COPI Gamma

SEQ ID NO: 807 - DNA, 602 bp, Psylliodes chrysocephala; identical to SEQ ID NO: 791
  misc_feature: COPI Gamma

SEQ ID NO: 808 - DNA, 602 bp, Psylliodes chrysocephala; identical to SEQ ID NO: 791
  misc_feature: COPI Gamma

SEQ ID NO: 809 - DNA, 602 bp, Psylliodes chrysocephala; identical to SEQ ID NO: 791
  misc_feature: COPI Gamma

SEQ ID NO: 810 - DNA, 602 bp, Psylliodes chrysocephala; identical to SEQ ID NO: 791
  misc_feature: COPI Gamma

SEQ ID NO: 811 - DNA, 602 bp, Psylliodes chrysocephala; identical to SEQ ID NO: 791
  misc_feature: COPI Gamma

SEQ ID NO: 812 - DNA, 602 bp, Psylliodes chrysocephala; identical to SEQ ID NO: 791
  misc_feature: COPI Gamma

SEQ ID NO: 813 - DNA, 602 bp, Psylliodes chrysocephala; identical to SEQ ID NO: 791
  misc_feature: COPI Gamma

SEQ ID NO: 814 - DNA, 602 bp, Psylliodes chrysocephala; identical to SEQ ID NO: 791
  misc_feature: COPI Gamma

SEQ ID NO: 815 - DNA, 602 bp, Psylliodes chrysocephala; identical to SEQ ID NO: 791
  misc_feature: COPI Gamma

SEQ ID NO: 816 - DNA, 602 bp, Psylliodes chrysocephala; identical to SEQ ID NO: 791
  misc_feature: COPI Gamma

SEQ ID NO: 817 - DNA, 1011 bp, Psylliodes chrysocephala
  misc_feature: Rpn8
acgggctttaaaatgcctagttcagacgtaacgacaactaaagttatagtccatccattggtcttacttagcgtagtggatcatttcaatcgtatgggaaaaatcggtaaccaaaaacgcgtcgtcggtgtcttactcggttgttggagggctaaaggagtcttggatgtttcgaatagtttcgcagttccttttgatgaggatgacaaagatcaatctgtgtggtttttggaccatgattacttagaaaatatgtacggcatgtttaaaaaagtcaatgctagagaacgtgtagtgggctggtaccacaccggacccaaattacaccaaaacgacattgctattaatgaactagtaagaagatactgtccaaattcagtattggtaattattgatgccaaaccaaaagacttaggccttcccacagaagcgtatcaagccgttgaggaagtacatgatgatggttcaccaacatccaaaacttttgaacacgtaccaagcgaaattggagcagaagaggctgaagaagtgggtgtagaacatttattacgtgatatcaaagatactactgttggcacactttctcaaagaattacaaatcaattgttgggtctgaagggactgcattcacagttgaaagacattagagactatttgttaaatgtttgtgacaatacgctacctattaatcatcaaattatctatcagttacaagatattttcaatttgctgcctgatataaaccaagatgcttttaacaattcattttatgttaaaaacaatgatcagatgcttgtagtctacttagcagctctggttagatccatagtggcattgcataatttaatcaataacaaactgacaaacaaagatgctgaggagggtaagaaagaagagaagaaggatagtaaggataaagataaggacagtaaggataaggatagtaaagataaagataaggaaaagggagaaaaggataaggatgcaaagaaggatgagaagaaaaagtag

SEQ ID NO: 818 - DNA, 1011 bp, Psylliodes chrysocephala; identical to SEQ ID NO: 817
  misc_feature: Rpn8

SEQ ID NO: 819 - DNA, 1011 bp, Psylliodes chrysocephala; identical to SEQ ID NO: 817
  misc_feature: Rpn8

SEQ ID NO: 820 - DNA, 1011 bp, Psylliodes chrysocephala; identical to SEQ ID NO: 817
  misc_feature: Rpn8

SEQ ID NO: 821 - DNA, 1011 bp, Psylliodes chrysocephala; identical to SEQ ID NO: 817
  misc_feature: Rpn8

SEQ ID NO: 822 - DNA, 1011 bp, Psylliodes chrysocephala; identical to SEQ ID NO: 817
  misc_feature: Rpn8

SEQ ID NO: 823 - DNA, 1011 bp, Psylliodes chrysocephala; identical to SEQ ID NO: 817
  misc_feature: Rpn8

SEQ ID NO: 824 - DNA, 705 bp, Psylliodes chrysocephala
  misc_feature: VATP-E/Vha26
aatcgtttctacaaatcaaccaaaatggctttaagtgacgcagatgtccaaaaacagatcaaacatatgatggctttcattgagcaagaagccaatgaaaaagctgaagaaatcgatgctaaggctgaggaggagttcaacatcgagaagggacgtctcgttcaacaacagaggctcaaaattatggaatattatgaaaagaaggaaaagcaggtcgaattacaaaagaaaatccaatcttccaacatgttgaaccaggcaaggttgaaggttctaaaagtgagagaagatcatgtccgtgctgttttagaagaagcccgtaaacgtctaggcgaagtcaccaaagaccaaggaaaatatggtcagattattgaaagcttgattctccaaggattgtaccagctctttgaaaaagaggtgaccgtcagagtgcgtccacaagatagagaattggtaaaatcgatcttgaacaatgtccaaaccaaatacaaggatatcacaggcaaagacatagtcttgaaaatcgatgatcagtcccatctatctcaagaaaccaccggaggaattgaactccttgccttgaggaacaagatcaagattaacaatactttggaagctcgtttggagctcatttcccaacagttggtacctcagattcgtaacgccctgttcggacgcaacgtcaacagaaaattcactgattaa

SEQ ID NO: 825 - DNA, 705 bp, Psylliodes chrysocephala; identical to SEQ ID NO: 824
  misc_feature: VATP-E/Vha26

SEQ ID NO: 826 - DNA, 705 bp, Psylliodes chrysocephala; identical to SEQ ID NO: 824
  misc_feature: VATP-E/Vha26

SEQ ID NO: 827 - DNA, 705 bp, Psylliodes chrysocephala; identical to SEQ ID NO: 824
  misc_feature: VATP-E/Vha26

SEQ ID NO: 828 - DNA, 705 bp, Psylliodes chrysocephala; identical to SEQ ID NO: 824
  misc_feature: VATP-E/Vha26

SEQ ID NO: 829 - DNA, 705 bp, Psylliodes chrysocephala; identical to SEQ ID NO: 824
  misc_feature: VATP-E/Vha26

SEQ ID NO: 830 - DNA, 2328 bp, Psylliodes chrysocephala
  misc_feature: sec23A
attcaaaaaatgagtacttacgaagaatacattcaacaaaacgaagaccgagatggaatcagatttacttggaatgtatggccatcgagtaggatagaagcaactcgtttggtagtaccattagcgtgtctttatcaaccgattaaagaacgtttagatcttccacccatacagtatgatcccgttctgtgtacaagaaataactgcagagcgattttaaatcctatgtgccaagttgattatcgagcaaaattgtgggtttgcaatttttgttttcaacgcaatccgtttccacctcaatatgcagctatttctgaacagcatcaacctgctgagttaatgcctatgttttcaactattgagtatactattactagagctcagtgtttaccaccgatattcttgtatgttgttgatacttgcatggatgaggaagaattgggttcacttaaagattctttacaaatgtcactcagtttattgcctccgaatgctttaattggtttgattacatttggaaaaatggtccaagttcatgaattaggtactgagggttgcagtaaatcatacgtctttagaggtactaaagatttaacagctaagcaagttcaagagatgttgggtattggtaaagttgctatggggcctcaacaacaaccaggtcaacctagacctggtcaaatgcaacctgcacctatcgcgccaggtagcagattcctacagcctgtatctaaatgcgatatgaatttaactgatttaataggagagcagcaaaaagatccctggcctgttcatcagggaaagagatctcttagatgtaccggtgttgctttatctatagctattggtttgttggagagcacttatcccaatacaggagctagagttatgctttttgttggaggaccgtgctctcaagggcctggtcaggttttgaatgatgatttaaaacaacctattagatctcatcatgatattcaaaaagataatgcaaagtatatgaaaaaaggtataaagcattatgatgctttggctatgagagcagcaactaatgggcattgtgttgatatttattcttgtgctttggatcagactggtttgatggagatgaaacagtgctgcaattctacaggcggtcacatggtaatgggagattcattcaattcctccctattcaaacagacattccaacgggtgttcaccaaagatcaaaagggcgaattaaaaatggctttcaacgggactctggaagtgaaatgttctagagaattgaaagtgcaaggagggattggttcttgcgtatcattgaatgtaaaaggtccgcttgtttcggataccgaaatcggtatgggaaatacggtgcaatggaaaatgtgcactttaactccaagtaccactatagcgctgtttttcgaagtggtcaatcagcattctgcaccgattcctcaaggaggaagaggatgcatacaatttattactcaatatcagcattctaatggtcagagaaggatcagagtgagtaccatagctcgtaattgggcggacgcgaccgcgaatattcatcacattagcgctgggttcgatcaagaagcggccgctgtaattatggccaggatggctgtatacagagcggaatcggacgatagtcctgatgttcttagatgggtggacaggatgttgattagattgtgtcaaaaattcggagaatacaacaaggacgacgcgaattcgttcagattgggtcaaaactttagcctctatccccaattcatgtaccatctgagacgttctcaattcctgcaagttttcaataattcaccggacgaaacgtcgtattatcggcacatgttaatgagagaagatctgacgcagtctttgattatgatccagccgattttgtacagttacagcttcaacgggcccccggaacccgttctgttggatacgagttcgattcaatcggagaggatattattgatggacactttcttccaaatattgatattccacggagagacaatagctcagtggcgtaacttgaaataccaagatatgccggaatacgaaaactttagacaactgttacaagcacccgtggacgatgctcaggaaatattgcagacgagatttcccatgccgagatacatcgataccgaacagggcggttctcaagctagatttttactatccaaagtcaatccgagtcaaactcataacaatatgtacgcatatggaggcgacgctggtgcgcccgttttgaccgacgatgtatcccttcaagtgttcatggatcatctaaaaaaattggcggtttcatctacagcttag

SEQ ID NO: 831 - DNA, 2328 bp, Psylliodes chrysocephala; identical to SEQ ID NO: 830
  misc_feature: sec23A

SEQ ID NO: 832 - DNA, 2328 bp, Psylliodes chrysocephala; identical to SEQ ID NO: 830
  misc_feature: sec23A

SEQ ID NO: 833 - DNA, 2328 bp, Psylliodes chrysocephala; identical to SEQ ID NO: 830
  misc_feature: sec23A

SEQ ID NO: 834 - DNA, 2328 bp, Psylliodes chrysocephala; identical to SEQ ID NO: 830
  misc_feature: sec23A

SEQ ID NO: 835 - DNA, 2328 bp, Psylliodes chrysocephala; identical to SEQ ID NO: 830
  misc_feature: sec23A

SEQ ID NO: 836 - DNA, 2328 bp, Psylliodes chrysocephala; identical to SEQ ID NO: 830
  misc_feature: sec23A

SEQ ID NO: 837 - DNA, 2328 bp, Psylliodes chrysocephala; identical to SEQ ID NO: 830
  misc_feature: sec23A

SEQ ID NO: 838 - DNA, 2328 bp, Psylliodes chrysocephala; identical to SEQ ID NO: 830
  misc_feature: sec23A

SEQ ID NO: 839 - DNA, 2328 bp, Psylliodes chrysocephala; identical to SEQ ID NO: 830
  misc_feature: sec23A

SEQ ID NO: 840 - DNA, 2328 bp, Psylliodes chrysocephala; identical to SEQ ID NO: 830
  misc_feature: sec23A

SEQ ID NO: 841 - DNA, 792 bp, Psylliodes chrysocephala
  misc_feature: Rps4
ctcaagatggctcgaggacctaaaaagcatttgaaacgtttaaatgcgccgaaagcatggatgttggacaaattgggaggtgtatttgctccacgtccatccaccggccctcacaaactaagggaatcattgcctttggtaattttcttgagaaataggctgaagtatgcccttacaaacagcgaagtaacaaaaattgttatgcaaagattgataaaagtcgatggaaaagttagaaccgatgccaattatccagctggatttatggatgttatcaccattgaaaaaactggagaatttttccgtcttatttatgatgtaaaaggaaggtttgccattcaccgtataacagctgaagaagctaaatacaaactttgcaaaattaggagagtccagactggaccaaaaaatataccattcattgtaacacatgatggacatacacttcgttatcccgaccccaacatcaaagtaaatgacaccattcaattggaaattgccacatctaaaatcctggactacattaagtttgaatctggtaacttgtgtatgattactggaggtagaaatttgggtcgtgttggtacggtaatcaatagggaacgtcatccaggatcctttgatattgtacacattaaggatgctaatggccacgtgtttgctactaggttacataatgtattcataattggtaagggagccaaagcttttgtatctcttccaagaggaaagggagttaagttgtccatagctgaagaaagagataagaggctagcagcaaaaacccactaa

SEQ ID NO: 842 - DNA, 792 bp, Psylliodes chrysocephala; identical to SEQ ID NO: 841
  misc_feature: Rps4

SEQ ID NO: 843 - DNA, 792 bp, Psylliodes chrysocephala; identical to SEQ ID NO: 841
  misc_feature: Rps4

SEQ ID NO: 844 - DNA, 792 bp, Psylliodes chrysocephala; identical to SEQ ID NO: 841
  misc_feature: Rps4

SEQ ID NO: 845 - DNA, 792 bp, Psylliodes chrysocephala; identical to SEQ ID NO: 841
  misc_feature: Rps4

SEQ ID NO: 846 - DNA, 792 bp, Psylliodes chrysocephala; identical to SEQ ID NO: 841
  misc_feature: Rps4

SEQ ID NO: 847 - DNA, 792 bp, Psylliodes chrysocephala; identical to SEQ ID NO: 841
  misc_feature: Rps4

SEQ ID NO: 848 - DNA, 792 bp, Psylliodes chrysocephala; identical to SEQ ID NO: 841
  misc_feature: Rps4

SEQ ID NO: 849 - DNA, 792 bp, Psylliodes chrysocephala; identical to SEQ ID NO: 841
  misc_feature: Rps4

SEQ ID NO: 850 - DNA, 792 bp, Psylliodes chrysocephala; identical to SEQ ID NO: 841
  misc_feature: Rps4

SEQ ID NO: 851 - DNA, 846 bp, Psylliodes chrysocephala
  misc_feature: Proteasome beta 5
tcaaccatgagtttggaagaaatttgtggaattccacaatataactctctagattatgaaagattaatgcacgatgatggcttgtccagatattgcaggaacttcgataatggcatggacttagcagtgcccccttttctaaatcaaagcaataattttgccaaatttacaaaggacgacagtggacgtgaaatcaaaattaattttgaccatggtacaactactctggggttcatgtacaaagggggtgtagtactcgctgtagactctagggcaacaggaggtcaattcattgggtcgcaaactatgaagaaaattgtagaaattaatgattttctgttgggtactttggctggaggagcagcagattgtgtatactgggatcgagttttagctaagcaatgtagaatgtatgaactcagaaatagggaaagaatttctgttgcagctgcttctaagttgatggccaacatggtttacaattacaagggaatggggttatctatgggaatgatgttggctggttgggacaagaggggtcctcaactttactatgtcgattctgaagggcttagaacacctggaaaagtgttcagtgtaggttcaggttccatctatgcttttggtgtgctcgattcaggttacaaatgggatttgacagacgaagaagcatatgatttaggtcgcaggtctatctatcatgctacccatagagatgcttattcaggaggtattgtaagagtataccacatgaaggagactggctgggaacttattgataataatgattgtaacgatttgcactataagtaccaagaggagaagtctaaagagggtggtgcttaa

SEQ ID NO: 852 - DNA, 846 bp, Psylliodes chrysocephala; identical to SEQ ID NO: 851
  misc_feature: Proteasome beta 5

SEQ ID NO: 853 - DNA, 846 bp, Psylliodes chrysocephala; identical to SEQ ID NO: 851
  misc_feature: Proteasome beta 5

SEQ ID NO: 854 - DNA, 846 bp, Psylliodes chrysocephala; identical to SEQ ID NO: 851
  misc_feature: Proteasome beta 5

SEQ ID NO: 855 - DNA, 846 bp, Psylliodes chrysocephala; identical to SEQ ID NO: 851
  misc_feature: Proteasome beta 5

SEQ ID NO: 856 - DNA, 846 bp, Psylliodes chrysocephala; identical to SEQ ID NO: 851
  misc_feature: Proteasome beta 5

SEQ ID NO: 857 - DNA, 846 bp, Psylliodes chrysocephala; identical to SEQ ID NO: 851
  misc_feature: Proteasome beta 5

SEQ ID NO: 858 - DNA, 846 bp, Psylliodes chrysocephala; identical to SEQ ID NO: 851
  misc_feature: Proteasome beta 5

SEQ ID NO: 859 - DNA, 846 bp, Psylliodes chrysocephala; identical to SEQ ID NO: 851
  misc_feature: Proteasome beta 5

SEQ ID NO: 860 - RNA, 247 nt, artificial sequence
  synthetic construct
gucccaucccggaauagaccauuccgaugugcuucgugaucauuuccacuuuguggacgcuguguucgucguaaagaauggauuugugcuuguuuuccguggcuauuaccacuccauuugaugcuuuuauuccuacugacggagcaccagccgcuacugccgcuaaagcauauucgauuuggacuaguuuaccugaagggcugaaaguuguuaaagaaaaacuauaacguucagaugacauuuucac

SEQ ID NO: 861 - RNA, 254 nt, artificial sequence
  synthetic construct
gaauuggccgccaguggcucgggaauccacugcgagcacuacgcccccuuuguacaugaaucccaauguggugguaccguggucgaacuugauuuugaucucacggccguuaucaucuuuggugaaccuugcaaaguuguugcugggaucaggaaaagggggaacagcuaaguucaugccauucuugaaauuggugcaauacuucugcaggcucucgucguaggcgagucgcucguaauccucggaauuguagc

SEQ ID NO: 862 - RNA, 255 nt, artificial sequence
  synthetic construct
guuucaccuucauucucuuggcguucgccuggucggccaacaucuuggcgcgcgccuucucggccuucuucuuguggauguauuccaucaggacgcgcuuguucuugaacacguuacccuucgccuucauguacagcgaaugguacagaugccugucgauuuucuuggccucgcgguacuucuucaacaaacgacggagcacccucauacguugaauccauaauucuuuucuugguguucgagcguucgcuguac

SEQ ID NO: 863 - RNA, 254 nt, artificial sequence
  synthetic construct
gauuuucucaguguaaugacgcgcuucuuagguccaauacaacaacccuuaaucaugacgaagucguuguuaacuucaccguaaugagggaaaccacccaucgguguaauaguuuucucacuaagaucguaaucgguagcagcauuguuuuugaugaccuuuccguccuuagugugaauuccagcgccgauucuguagauuuucuuguucaucuccguccugugaugguaacccuuuugaccagcacgagcgac

SEQ ID NO: 864 - RNA, 260 nt, artificial sequence
  synthetic construct
gccuuaacauuuucgauaguaucagaugguucaacuucaagaguaauuguuuuaccaguaagaguuuuaacgaauauuugcauuccuccacguagacgaagaacuaaaugcaguguggacucuuuuugaauauuguagucagacaauguucugccaucuuccaguuguuuaccggcgaagauuaaacguugcugaucuggaggaauccccucuuugucuuggauuuucgccuuaacguucucaauaguaucagaugguuc

SEQ ID NO: 865 - RNA, 247 nt, artificial sequence
  synthetic construct
gaaguuuuuggcuaagauuccaucuuucuucguuaaccucacaauacaaucguccgauucucccauacgccugauagcuccgcagagggcguagcuuuuggaacuuucggucauccuuccgguuaaaggaucgacaucggcuacgcugaguugaaugcuagcgugguccuuagcaugaauaauucuguugcuagcagagcauuuccuugggcaguacaagucgacgguuucaccagcgucguuuucc

SEQ ID NO: 866 - RNA, 258 nt, artificial sequence
  synthetic construct
guguguuuuugcagcuagccuuuuaucccuuucuucggcuauggacaacuuaacacccuuaccucuuggaagagauacaaaggcuuuagcuccuuuaccaaucacgaauacauuauuuaaucuaguugcaaaagcaugaccauuggcguccuuaauguguacaauaucgaaggaaccgggaugacgcucccuguucauaauuguaccaacacgucccaaauuucuaccuccgguaaucaugcacaaguuguuugauuc

SEQ ID NO: 867 - RNA, 265 nt, artificial sequence
  synthetic construct
guuaucauuaagcguaaucacuuucagcuguugccucaugguccuggcaggauuuugcaggauuucgaaacuaggcucgggcuccuuuuucuucuccuccuuaucaucuuucuuaucuuuuuugucgucgcucgacgacgccgcuuuuuuaucgucgguuuucuuaucaucggacuuuuucuccucuuucuucucuucgguuuucuucuccuucuccuccuucucgggcuucuuaucgucuuuaucuucguccacauccauuuuc

SEQ ID NO: 868 - RNA, 272 nt, artificial sequence
  synthetic construct
gcacccuucucucucuuaacgcguacauaccagccucggugcaaacacccuucacuucggcaccgcuagcgcccggcaucaauucggcgauuuuccucagauugauuccucuggucaaauucauuuuucuagagugaauuuucaggauguccaaucgggcuuccucguucgguggcgggaauucgauuuuccugucgauucugccgggucugagcaaagccgggucuaaaauaucgauucuguugguggccaugaugacuuuaauguuuuuc

SEQ ID NO: 869 - RNA, 258 nt, artificial sequence
  synthetic construct
gcuccggagggccguugaaacuguaacuguacaaaauugguugaaucaugaucaaugauugaguaagaucuucucucaucagcauaugucgauagaacgacguuucaucaggagaauuauugaaaacuugcaggaacugagaccuccuuagaugguacaugaauugcggauagaggcuaaaguuuuggcccaaucugaaugaaccagcaucgucuuuauuguauucuccgaauuuuugacacaaucgaaucagcauuc

SEQ ID NO: 870 - RNA, 252 nt, artificial sequence
  synthetic construct
gaucuggauggcccaacaugucuuuugauuuauacguuuucaaggcccaagaaaguauuguaacguauucguuaccuuugagcccguuuuguauaauuucuuguagauguacagaaagaccaccaugauacauaugaauguauuugucuaauauuuuguaacuugguggaaaacaaggaagacagaguguuuuaacaauucucaaaucuucuaagaucaucauucuaauuaguucuaaauaacguauaagcc

SEQ ID NO: 871 - RNA, 251 nt, artificial sequence
  synthetic construct
guuccaucuauuuguaguugcguuuuuuccaaucguuucuucuuuuugagcgcuugaagcgccacucuuuuguucuucgaugcauucuuuuuggcuacuaaaguguauuccucuauuuucuuuucuaaaaacucuuguuuuuuauauaacauguccucgguuucccugagcuuuuggauggccuccccgggcguagggcccucgucuuuuuccuuuccuccgaauauuuuacuaaagaaacucauuuuucc

SEQ ID NO: 872 - RNA, 254 nt, artificial sequence
  synthetic construct
gccgacgacaaaagggcgucuuucgcgugguuuuucuuaacauccagcgagucuuugaugaaaaguucggcuugagcgcaaaaaucgucuucuugaauguaaauuucgcuuagagccugcgcguugugcucuuuacaguauuuuaugaacagcgauugagcgauagggaaauuucugauggucaucuuaaaguccccuaaaggcauguuuucucucaauuucaauaugacaguauaaacuaaauccguaucgcc

SEQ ID NO: 873 - RNA, 238 nt, artificial sequence
  synthetic construct
gggggggaucgauuugcuggcguugaagaacaaagugaagaucaacaacacgcuggaggcgcgauuggacuugaucucgcagcaauuggugccucaaauccguaacgcucuguucgggcguaacgugaacaggaaauucaccgauuagguugcuugggguuugugcgaucguauaauauuuacaucggucgaaauaaaauaguauucgauuuauaaaauuuauuguaauguuaucauc

SEQ ID NO: 874 - RNA, 267 nt, artificial sequence
  synthetic construct
guacaucccaaucauguucuucaacauacccacgguuuuguagaagggacagaaucugucguacgaugaguacgaguucuguugcaggaaaucuucuuucaacagcuuggcgauuuccaauguaauuuuaucagcuucggccaaugaagcuuuuccuaccagcugcacgauuucuguaagaucgucuucuucuugaagaauuuccuuaacuuugguucugagcgguaugaauuccgcaaaguuuuugucauagaaaucaucuaaggc

SEQ ID NO: 875 - RNA, 257 nt, artificial sequence
  synthetic construct
guuuucaccauaucucaacgccaauuuggucaaaguagaggccaaagaagcugcaaugaaaaaaucuccauccaugagauauugccucaauggaggucucuucucuuuuguagauuugcuggccacguugaaagcagauugaguggcguaaguuccauccgaaguaaccaaagugguggccccggcuggugcaugagcuggcgcacuaucaucuguacuacccgauauaaucuuuugcucagacuccaacagagggc

SEQ ID NO: 876 - RNA, 240 nt, artificial sequence
  synthetic construct
gucgucaucuauauugauauccguuguaucuauauuuucaucaauguucacuccaucaagauccaaauccaaaucguccucaucagcuucuucauuaucaacagaggguuuguucguuuguucaaccgguguuucgccgagcaaauuaucgaaauaacuugcaccugaauuuuugacuuucgcuugaaccuccgcuaucauauuucugucgugauucgguguaacggugacagccgaagc

SEQ ID NO: 877 - RNA, 269 nt, artificial sequence
  synthetic construct
gccaaggcggugauuuccuuuugcauacggucagcaauaccaggguacauggugguaccaccggacaagacgguguuggcguacaaguccuuacggauaucgacgucacacuucaugauggaguuguagacgguuucguggauaccgcaggauuccauacccaagaaggaagguuggaauagagccucaggacaacggaaucucucguuaccgauggugaugacuugaccgucggguaauucguagcucuuuuccaaugagguggaagc

SEQ ID NO: 878 - RNA, 351 nt, artificial sequence
  synthetic construct
guaagguuuuccucaagguuuccauuugcaaaccgcaaauauauucgcuggcuauucucaguaauugcugagccucggaaauuucuuguuuguuguccaccacaagcaauguaacggacaacagcagaguuuguaauuucucgauggcuucagugaauuuaccaccaguggucaguugauagcaaaucugcaauuuagcgaccaaaucguucaauuucaccccagaagcggguaacugguuuuuaauauuggcuuccuuccaguuucucaacggguaacuaaacgaaggcgguacguuuuguugccaagacgacaccgucuucgaaguacuguacaaauugaugaacaagc

SEQ ID NO: 879 - RNA, 352 nt, artificial sequence
  synthetic construct
guucuaauuugaauaucaccaugccgccaucguggccagcagcgaauaaauuaagauucggguggcucgucaucacccaaaaucguucguguucccuucuaaaaguaugcaagcaaguccuuuuagccauaucccaaacccuuauacuucuaucuucaccguuagacagaaucagcuccugucuaggaugaaacaaaacgcaagacacguuguuguaauguccucuacaaguaucuacuucccaagcuuucgaaucguucauucuccacagcuuuauuugccugucaucggcuccggaagcuauuaaagguaggaaaggaugaaaagaugcccaauucacuccucgaucguc

SEQ ID NO: 880 - RNA, 351 nt, artificial sequence
  synthetic construct
gagugguaaaaucgaguuuucuuaaauacuucucuuugacguaauacaguagguucccguguaccguguaagcuggucguucgcguucuaauuugaauaucaccaugccgccaucguggccagcagcgaauaaauuaagauucggguggcucgucaucacccaaaaucguucguguucccuucuaaaaguaugcaagcaaguccuuuuagccauaucccaaacccuuauacuucuaucuucaccguuagacagaaucagcuccugucuaggaugaaacaaaacgcaagacacguuguuguaauguccucuacaaguaucuacuucccaagcuuucgaaucguucauucucc

SEQ ID NO: 881 - RNA, 350 nt, artificial sequence
  synthetic construct
gauauaauacuuuggccuaccaaucgagaauuccugaccauguacaaaaccucuucguacuugugauugaucaaugcgaguuugaauuuguauucagugggaucgauuaccaacaggcgaggcuuacauucccuguccaaacagaacaccugacuaccucugacucuaguuauguaaaugggaagauccaggguucuaauaauuccgugaucaccauuuuucaacguguauuuaauaugauuacuaguaguguaaaugaaaacgccgcuaucaucccaagcgcccgacuuaacucugguauucucguguaacgaacacagaacauccaauuuucuauuacaaaucgucac

SEQ ID NO: 882 - RNA, 352 nt, artificial sequence
  synthetic construct
guaccuaaacugaugcgugcuaauccucaauccaaucguauccuuuccaacuuccgccacuuugcaaauauuacacaauaccccuuuguauuuagguaaauaugaaguaccgcauaauggacauuucucuucggccuuuccccuguaaauggguguauaagagugcccacacaaguugaaaggauugugcucgucauacugcaauugcaaaucaucuguaagauuagaaucgcaagccuguaauauuuuucuagcuugcugggcuacuucaggccuaggaccaaguuccaacagccucuuggcgaaagaagcggcuguuuuguaguucuugagcuugaaaaacauguugagc

SEQ ID NO: 883 - RNA, 352 nt, artificial sequence
  synthetic construct
guuacaaugcgugaaauaggcagccaucucgcacugacguuucugcucuucggcugaaguuuucgguaagguuuuccucaagguuuccauuugcaaaccgcaaauauauucgcuggcuauucucaguaauugcugagccucggaaauuucuuguuuguuguccaccacaagcaauguaacggacaacagcagaguuuguaauuucucgauggcuucagugaauuuaccaccaguggucaguugauagcaaaucugcaauuuagcgaccaaaucguucaauuucaccccagaagcggguaacugguuuuuaauauuggcuuccuuccaguuucucaacggguaacuaaacgac

SEQ ID NO: 884 - RNA, 352 nt, artificial sequence
  synthetic construct
guaguguaaaugaaaacgccgcuaucaucccaagcgcccgacuuaacucugguauucucguguaacgaacacagaacauccaauuuucuauuacaaaucgucacguuaugcuuagauagaagagcuagaugcgacauaucagaagaccacacgacguaucuacauuugcugauuuuaacuugagccaauguccucuuuuguuggacaucaaacaacguaacguguucggaaucucucaauaaaagcaugccaguuccggcguaaaagacuucaucgcaagugggcguuugaacuuuuuuaguuaccucguuuuucagauuuuuaaugaucaacuggugcguccuguccaguc

SEQ ID NO: 885 - RNA, 351 nt, artificial sequence
  synthetic construct
guaugauuacuaguaguguaaaugaaaacgccgcuaucaucccaagcgcccgacuuaacucugguauucucguguaacgaacacagaacauccaauuuucuauuacaaaucgucacguuaugcuuagauagaagagcuagaugcgacauaucagaagaccacacgacguaucuacauuugcugauuuuaacuugagccaauguccucuuuuguuggacaucaaacaacguaacguguucggaaucucucaauaaaagcaugccaguuccggcguaaaagacuucaucgcaagugggcguuugaacuuuuuuaguuaccucguuuuucagauuuuuaaugaucaacuggugc

SEQ ID NO: 886 - RNA, 351 nt, artificial sequence
  synthetic construct
gaggauuuuugaggugaucuucgagccccgagggacccggugauacguucuucuuacguaguccagaaauaucccaaacucuaacaguagaauccaaugaagcggauaacaguagauccucgcuaggauggaaaguagcgcacaugacauagugauuguggccgguuaaaacgcaaaugcacguucuggauugccaguuccauauccggaugguuugaucaucggaugcggauacuauccagggauauucgugguggaacauagucgugcgaauguaauccaaaugcccaagcagugugaagaugcaacguuucuguuuguaguuccauacuuuuauuuuguaaucaucgc

SEQ ID NO: 887 - RNA, 351 nt, artificial sequence
  synthetic construct
gaaucgagaauuccugaccauguacaaaaccucuucguacuugugauugaucaaugcgaguuugaauuuguauucagugggaucgauuaccaacaggcgaggcuuacauucccuguccaaacagaacaccugacuaccucugacucuaguuauguaaaugggaagauccaggguucuaauaauuccgugaucaccauuuuucaacguguauuuaauaugauuacuaguaguguaaaugaaaacgccgcuaucaucccaagcgcccgacuuaacucugguauucucguguaacgaacacagaacauccaauuuucuauuacaaaucgucacguuaugcuuagauagaagagc

SEQ ID NO: 888 - RNA, 351 nt, artificial sequence
  synthetic construct
guaccuaaacugaugcgugcuaauccucaauccaaucguauccuuuccaacuuccgccacuuugcaaauauuacacaauaccccuuuguauuuagguaaauaugaaguaccgcauaauggacauuucucuucggccuuuccccuguaaauggguguauaagagugcccacacaaguugaaaggauugugcucgucauacugcaauugcaaaucaucuguaagauuagaaucgcaagccuguaauauuuuucuagcuugcugggcuacuucaggccuaggaccaaguuccaacagccucuuggcgaaagaagcggcuguuuuguaguucuugagcuugaaaaacauguugac

SEQ ID NO: 889 - RNA, 351 nt, artificial sequence
  synthetic construct
guauaggaacgaauucuucagccgguuccuccuuuuuguccucuuuuucgaucuuaucguccuguucauuuuuaccgucuugcucauucuucucaucuguuucauucugaucgucuuucucgucuuguuuguccucaucuuucuucucguuuacuucacucucaguagucuccauugguuccacugccucagccucgguuugauccuucucuuccuucucgcugggaauuucuucgucuuuauucucacucacguuaucagucucuuuggggucuucuuucgguuucucugaaucguuuuugacguuaucagcguuucucuuaucgucucugucguaauaaucucuucugc

SEQ ID NO: 890 - RNA, 351 nt, artificial sequence
  synthetic construct
guuuguccauucacggugaacuguagcguuauagaagagucguugauguccaaaaaugcaccgauuacgucuccaacgucgaauguuauuccguaaucagagaacuccuuauuuuuaacgauuuuuccugaagaaucguagccguaugauuuaucaucuucacccaauuguagugaaguccaagcggcugaccaacccaaucuaauaaagugaguggguauaggaacgaauucuucagccgguuccuccuuuuuguccucuuuuucgaucuuaucguccuguucauuuuuaccgucuugcucauucuucucaucuguuucauucugaucgucuuucucgucuuguuugucc

SEQ ID NO: 891 - RNA, 351 nt, artificial sequence
  synthetic construct
gaacgaauucuucagccgguuccuccuuuuuguccucuuuuucgaucuuaucguccuguucauuuuuaccgucuugcucauucuucucaucuguuucauucugaucgucuuucucgucuuguuuguccucaucuuucuucucguuuacuucacucucaguagucuccauugguuccacugccucagccucgguuugauccuucucuuccuucucgcugggaauuucuucgucuuuauucucacucacguuaucagucucuuuggggucuucuuucgguuucucugaaucguuuuugacguuaucagcguuucucuuaucgucucugucguaauaaucucuucugcuucguc

SEQ ID NO: 892 - RNA, 351 nt, artificial sequence
  synthetic construct
gaggaacgaauucuucagccgguuccuccuuuuuguccucuuuuucgaucuuaucguccuguucauuuuuaccgucuugcucauucuucucaucuguuucauucugaucgucuuucucgucuuguuuguccucaucuuucuucucguuuacuucacucucaguagucuccauugguuccacugccucagccucgguuugauccuucucuuccuucucgcugggaauuucuucgucuuuauucucacucacguuaucagucucuuuggggucuucuuucgguuucucugaaucguuuuugacguuaucagcguuucucuuaucgucucugucguaauaaucucuucugcuuc

SEQ ID NO: 893 - RNA, 351 nt, artificial sequence
  synthetic construct
gcggugaacuguagcguuauagaagagucguugauguccaaaaaugcaccgauuacgucuccaacgucgaauguuauuccguaaucagagaacuccuuauuuuuaacgauuuuuccugaagaaucguagccguaugauuuaucaucuucacccaauuguagugaaguccaagcggcugaccaacccaaucuaauaaagugaguggguauaggaacgaauucuucagccgguuccuccuuuuuguccucuuuuucgaucuuaucguccuguucauuuuuaccgucuugcucauucuucucaucuguuucauucugaucgucuuucucgucuuguuuguccucaucuuucuuc

SEQ ID NO: 894 - RNA, 351 nt, artificial sequence
  synthetic construct
guuucauucugaucgucuuucucgucuuguuuguccucaucuuucuucucguuuacuucacucucaguagucuccauugguuccacugccucagccucgguuugauccuucucuuccuucucgcugggaauuucuucgucuuuauucucacucacguuaucagucucuuuggggucuucuuucgguuucucugaaucguuuuugacguuaucagcguuucucuuaucgucucugucguaauaaucucuucugcuucgucuauccgaccuguaccgguuaucucgaugaucugguuguuguugccaaucgucccauuuuaauuucucaguuacuuucauuucguaauaaacc

SEQ ID NO: 895 - RNA, 351 nt, artificial sequence
  synthetic construct
gguguagguucuaguguugccacagguucguugguuguuucggauuuacccucgucggguuguugcuuuucuggagacggggcgcucuccuugacccucgcuucauccuuugcuuccguaagcaagguauuuuuuggcguuaggucuucuucgacuuccucugucgagguaucuaauauugauguaucagcuauuucuucaucuaauucguucucuaaagcuucuuuuaaacguuuaacgaguauagguuuggugccuuucacgucgagcccucgagccgaaaguucauuccguaaaucuacuaccuucaguuuagccggaucuaucuuggaacucaucguguaagauauc

SEQ ID NO: 896 - RNA, 351 nt, artificial sequence
  synthetic construct
gcguuauagaagagucguugauguccaaaaaugcaccgauuacgucuccaacgucgaauguuauuccguaaucagagaacuccuuauuuuuaacgauuuuuccugaagaaucguagccguaugauuuaucaucuucacccaauuguagugaaguccaagcggcugaccaacccaaucuaauaaagugaguggguauaggaacgaauucuucagccgguuccuccuuuuuguccucuuuuucgaucuuaucguccuguucauuuuuaccgucuugcucauucuucucaucuguuucauucugaucgucuuucucgucuuguuuguccucaucuuucuucucguuuacuucac

SEQ ID NO: 897 - RNA, 351 nt, artificial sequence
  synthetic construct
guuaacgauuuuuccugaagaaucguagccguaugauuuaucaucuucacccaauuguagugaaguccaagcggcugaccaacccaaucuaauaaagugaguggguauaggaacgaauucuucagccgguuccuccuuuuuguccucuuuuucgaucuuaucguccuguucauuuuuaccgucuugcucauucuucucaucuguuucauucugaucgucuuucucgucuuguuuguccucaucuuucuucucguuuacuucacucucaguagucuccauugguuccacugccucagccucgguuugauccuucucuuccuucucgcugggaauuucuucgucuuuauucuc

SEQ ID NO: 898 - RNA, 352 nt, artificial sequence
  synthetic construct
gucuaauaaagugaguggguauaggaacgaauucuucagccgguuccuccuuuuuguccucuuuuucgaucuuaucguccuguucauuuuuaccgucuugcucauucuucucaucuguuucauucugaucgucuuucucgucuuguuuguccucaucuuucuucucguuuacuucacucucaguagucuccauugguuccacugccucagccucgguuugauccuucucuuccuucucgcugggaauuucuucgucuuuauucucacucacguuaucagucucuuuggggucuucuuucgguuucucugaaucguuuuugacguuaucagcguuucucuuaucgucucuguc

SEQ ID NO: 899 - RNA, 350 nt, artificial sequence
  synthetic construct
gggauagaacgugcgggauuagcgucaaaucaucggguaaaucgucccuggguauuucaauagucgguugaauuuguccauucacggugaacuguagcguuauagaagagucguugauguccaaaaaugcaccgauuacgucuccaacgucgaauguuauuccguaaucagagaacuccuuauuuuuaacgauuuuuccugaagaaucguagccguaugauuuaucaucuucacccaauuguagugaaguccaagcggcugaccaacccaaucuaauaaagugaguggguauaggaacgaauucuucagccgguuccuccuuuuuguccucuuuuucgaucuuaucgucc

SEQ ID NO: 900 - RNA, 352 nt, artificial sequence
  synthetic construct
guagcaucuuuaucuauagcuuccugcaaagcagcuucagcuuccucguauuuagccugcccuauaaaggccacugcuugcccguuuaacagaagaggcgucgagccauauuuaucaaccauuucuugguaaauguaguaagcaucuugcaauuuaucaccuccaauugcaacauuaacccaagcuugcgcuagcuguguuaacguagcaucaucaucuuuauccugcauuuccuugagcuucuucuuagccaaaucuacccgaucuaacuucaauaauauaucgaugaugaaggcguaagcuuccagauuuuccgaagcgugaagcacuuuguaagcggcuuccaaguugc

SEQ ID NO: 901 - RNA, 352 nt, artificial sequence
  synthetic construct
guuuaucuauagcuuccugcaaagcagcuucagcuuccucguauuuagccugcccuauaaaggccacugcuugcccguuuaacagaagaggcgucgagccauauuuaucaaccauuucuugguaaauguaguaagcaucuugcaauuuaucaccuccaauugcaacauuaacccaagcuugcgcuagcuguguuaacguagcaucaucaucuuuauccugcauuuccuugagcuucuucuuagccaaaucuacccgaucuaacuucaauaauauaucgaugaugaaggcguaagcuuccagauuuuccgaagcgugaagcacuuuguaagcggcuuccaaguugccuucguc

SEQ ID NO: 902 - RNA, 351 nt, artificial sequence
  synthetic construct
gugcuucaaguccuuuauguaaggauggucgggauuggcgucuuucaauugcgauaaauaucuauuagcaaucucaggaccuuuccccauaugccuuugaagaguaauuaaauuaaccaauguaucaggauaauuagcaucuuuaucuauagcuuccugcaaagcagcuucagcuuccucguauuuagccugcccuauaaaggccacugcuugcccguuuaacagaagaggcgucgagccauauuuaucaaccauuucuugguaaauguaguaagcaucuugcaauuuaucaccuccaauugcaacauuaacccaagcuugcgcuagcuguguuaacguagcaucaucauc

SEQ ID NO: 903 - RNA, 351 nt, artificial sequence
  synthetic construct
guacgauggaaugguaauuacuguagguguauacuguugacauauucucuggaacucgcucucuuuaugcuucaaguccuuuauguaaggauggucgggauuggcgucuuucaauugcgauaaauaucuauuagcaaucucaggaccuuuccccauaugccuuugaagaguaauuaaauuaaccaauguaucaggauaauuagcaucuuuaucuauagcuuccugcaaagcagcuucagcuuccucguauuuagccugcccuauaaaggccacugcuugcccguuuaacagaagaggcgucgagccauauuuaucaaccauuucuugguaaauguaguaagcaucuugcac

SEQ ID NO: 904 - RNA, 352 nt, artificial sequence
  synthetic construct
guuaaauuaaccaauguaucaggauaauuagcaucuuuaucuauagcuuccugcaaagcagcuucagcuuccucguauuuagccugcccuauaaaggccacugcuugcccguuuaacagaagaggcgucgagccauauuuaucaaccauuucuugguaaauguaguaagcaucuugcaauuuaucaccuccaauugcaacauuaacccaagcuugcgcuagcuguguuaacguagcaucaucaucuuuauccugcauuuccuugagcuucuucuuagccaaaucuacccgaucuaacuucaauaauauaucgaugaugaaggcguaagcuuccagauuuuccgaagcgugac

SEQ ID NO: 905 - RNA, 352 nt, artificial sequence
  synthetic construct
guauucucuggaacucgcucucuuuaugcuucaaguccuuuauguaaggauggucgggauuggcgucuuucaauugcgauaaauaucuauuagcaaucucaggaccuuuccccauaugccuuugaagaguaauuaaauuaaccaauguaucaggauaauuagcaucuuuaucuauagcuuccugcaaagcagcuucagcuuccucguauuuagccugcccuauaaaggccacugcuugcccguuuaacagaagaggcgucgagccauauuuaucaaccauuucuugguaaauguaguaagcaucuugcaauuuaucaccuccaauugcaacauuaacccaagcuugcgcuac

SEQ ID NO: 906 - RNA, 351 nt, artificial sequence
  synthetic construct
gccuuuauguaaggauggucgggauuggcgucuuucaauugcgauaaauaucuauuagcaaucucaggaccuuuccccauaugccuuugaagaguaauuaaauuaaccaauguaucaggauaauuagcaucuuuaucuauagcuuccugcaaagcagcuucagcuuccucguauuuagccugcccuauaaaggccacugcuugcccguuuaacagaagaggcgucgagccauauuuaucaaccauuucuugguaaauguaguaagcaucuugcaauuuaucaccuccaauugcaacauuaacccaagcuugcgcuagcuguguuaacguagcaucaucaucuuuauccugc

SEQ ID NO: 907 - RNA, 352 nt, artificial sequence
  synthetic construct
guuacuguagguguauacuguugacauauucucuggaacucgcucucuuuaugcuucaaguccuuuauguaaggauggucgggauuggcgucuuucaauugcgauaaauaucuauuagcaaucucaggaccuuuccccauaugccuuugaagaguaauuaaauuaaccaauguaucaggauaauuagcaucuuuaucuauagcuuccugcaaagcagcuucagcuuccucguauuuagccugcccuauaaaggccacugcuugcccguuuaacagaagaggcgucgagccauauuuaucaaccauuucuugguaaauguaguaagcaucuugcaauuuaucaccuccaauuc

SEQ ID NO: 908 - RNA, 352 nt, artificial sequence
  synthetic construct
gcaaucucaggaccuuuccccauaugccuuugaagaguaauuaaauuaaccaauguaucaggauaauuagcaucuuuaucuauagcuuccugcaaagcagcuucagcuuccucguauuuagccugcccuauaaaggccacugcuugcccguuuaacagaagaggcgucgagccauauuuaucaaccauuucuugguaaauguaguaagcaucuugcaauuuaucaccuccaauugcaacauuaacccaagcuugcgcuagcuguguuaacguagcaucaucaucuuuauccugcauuuccuugagcuucuucuuagccaaaucuacccgaucuaacuucaauaauauaucgc

SEQ ID NO: 909 - RNA, 352 nt, artificial sequence
  synthetic construct
gacuagggugucguugcuggcguucgccauuacuugcuggucgauuugagacacuacggcauccuucuugacuuuaccggauagguacucagccaggaguuuuagugguuggauuucuggagaggaggccccguggauuucgucuaguacgacuaagaauuuguucugggccauguacgaucuguaggugaauacgucucgcuggauggcgacuucugggguugagggcuuucuuaguuuuugcccuucguuuaugcauuguugguaguuuccuauguaaaaguaguuuuuaauuucgaaaagcucgucuacgucuugcugcugacgugccauuuuuguuuugauuuuuuuc

SEQ ID NO: 910 - RNA, 352 nt, artificial sequence
  synthetic construct
guaaauaucuauuagcaaucucaggaccuuuccccauaugccuuugaagaguaauuaaauuaaccaauguaucaggauaauuagcaucuuuaucuauagcuuccugcaaagcagcuucagcuuccucguauuuagccugcccuauaaaggccacugcuugcccguuuaacagaagaggcgucgagccauauuuaucaaccauuucuugguaaauguaguaagcaucuugcaauuuaucaccuccaauugcaacauuaacccaagcuugcgcuagcuguguuaacguagcaucaucaucuuuauccugcauuuccuugagcuucuucuuagccaaaucuacccgaucuaacuc

SEQ ID NO: 911 - RNA, 351 nt, artificial sequence
  synthetic construct
guaaccuacagaagagguaauaagcucagcuaugcugucaucgggugaucuuacagucaauugcauuguaacaccauccgccaaagcaaguuuagcucuuaccaaaauaucgauuccuccucuaaagacuccugauaguagaagcgugugggugcucuugccuucgggcacuuuaucaguucuuucggccgguugcaauccaaggaacugcacgauauucuucacagcuucguccaacguauucaucgaacugagagaauacguauccuccuuuuccacggaacccucagcagccgauucccaagcggcgccccaauugccuuugcucacucucuguaucugaucgcccac

SEQ ID NO: 912 - RNA, 352 nt, artificial sequence
  synthetic construct
guuucagacacgaaacucgcuauuugcuucauuagacgaucgaccgaagauucagcaccuguuuucaacaaaguaguaauagcuaaaguggcaauggaucuguuagaaucgguaaucagauucuccaaauccaaauuacaagccguaacagcagcaggaugugaaaucgccacuugauucaauguucugacagcggcaaaucuuaaaguagccuucggugaaccgcagaauaauuguaaaacgcuuacggcaggcgcuaauucuuugcuaguagugcguuuuagauugacaauggcgugggcagcuucguaaacuaccauuucggauuugugucucagacaggacucgaugc

SEQ ID NO: 913 - RNA, 350 nt, artificial sequence
  synthetic construct
gacacgaaacucgcuauuugcuucauuagacgaucgaccgaagauucagcaccuguuuucaacaaaguaguaauagcuaaaguggcaauggaucuguuagaaucgguaaucagauucuccaaauccaaauuacaagccguaacagcagcaggaugugaaaucgccacuugauucaauguucugacagcggcaaaucuuaaaguagccuucggugaaccgcagaauaauuguaaaacgcuuacggcaggcgcuaauucuuugcuaguagugcguuuuagauugacaauggcgugggcagcuucguaaacuaccauuucggauuugugucucagacaggacucgaugaaauc

SEQ ID NO: 914 - RNA, 352 nt, artificial sequence
  synthetic construct
guucuaacagcuaaugaaacguguucgcaaucuucgauaaacucgcacagaugagccaaaccugacucuuuagcuucaggauuaucuucgauuaugguaauuauggugucugcaauggaagcuuuguacuccaaaccgccuucaucucuuagcauagccgauaaaaaguucaugagcguguuguguuuacgagggaauuuaagagccagugcucugaucgcuugaacuaccacaacuuugaauucaucgcuaauuucagacacgaaacucgcuauuugcuucauuagacgaucgaccgaagauucagcaccuguuuucaacaaaguaguaauagcuaaaguggcaauggauc

SEQ ID NO: 915 - RNA, 352 nt, artificial sequence
  synthetic construct
gcaauugcauuguaacaccauccgccaaagcaaguuuagcucuuaccaaaauaucgauuccuccucuaaagacuccugauaguagaagcgugugggugcucuugccuucgggcacuuuaucaguucuuucggccgguugcaauccaaggaacugcacgauauucuucacagcuucguccaacguauucaucgaacugagagaauacguauccuccuuuuccacggaacccucagcagccgauucccaagcggcgccccaauugccuuugcucacucucuguaucugaucgcccaacguuauuuccaagucuucgaguauguauucaucauuguaaccuucaucgcuaucggc

SEQ ID NO: 916 - RNA, 352 nt, artificial sequence
  synthetic construct
guacagaagagguaauaagcucagcuaugcugucaucgggugaucuuacagucaauugcauuguaacaccauccgccaaagcaaguuuagcucuuaccaaaauaucgauuccuccucuaaagacuccugauaguagaagcgugugggugcucuugccuucgggcacuuuaucaguucuuucggccgguugcaauccaaggaacugcacgauauucuucacagcuucguccaacguauucaucgaacugagagaauacguauccuccuuuuccacggaacccucagcagccgauucccaagcggcgccccaauugccuuugcucacucucuguaucugaucgcccaacguuac

SEQ ID NO: 917 - RNA, 352 nt, artificial sequence
  synthetic construct
guaaacucgcacagaugagccaaaccugacucuuuagcuucaggauuaucuucgauuaugguaauuauggugucugcaauggaagcuuuguacuccaaaccgccuucaucucuuagcauagccgauaaaaaguucaugagcguguuguguuuacgagggaauuuaagagccagugcucugaucgcuugaacuaccacaacuuugaauucaucgcuaauuucagacacgaaacucgcuauuugcuucauuagacgaucgaccgaagauucagcaccuguuuucaacaaaguaguaauagcuaaaguggcaauggaucuguuagaaucgguaaucagauucuccaaauccaaac

SEQ ID NO: 918 - RNA, 352 nt, artificial sequence
  synthetic construct
guucaucucuuagcauagccgauaaaaaguucaugagcguguuguguuuacgagggaauuuaagagccagugcucugaucgcuugaacuaccacaacuuugaauucaucgcuaauuucagacacgaaacucgcuauuugcuucauuagacgaucgaccgaagauucagcaccuguuuucaacaaaguaguaauagcuaaaguggcaauggaucuguuagaaucgguaaucagauucuccaaauccaaauuacaagccguaacagcagcaggaugugaaaucgccacuugauucaauguucugacagcggcaaaucuuaaaguagccuucggugaaccgcagaauaauuguac

SEQ ID NO: 919 - RNA, 351 nt, artificial sequence
  synthetic construct
guuaccaaaauaucgauuccuccucuaaagacuccugauaguagaagcgugugggugcucuugccuucgggcacuuuaucaguucuuucggccgguugcaauccaaggaacugcacgauauucuucacagcuucguccaacguauucaucgaacugagagaauacguauccuccuuuuccacggaacccucagcagccgauucccaagcggcgccccaauugccuuugcucacucucuguaucugaucgcccaacguuauuuccaagucuucgaguauguauucaucauuguaaccuucaucgcuaucgggaaugccgguggugggaucgcaaucuuuaacgauaaacuuc

SEQ ID NO: 920 - RNA, 351 nt, artificial sequence
  synthetic construct
guaacgaaucuaaaacuacccucuucuccauauucuuccuuagaauuuggcucacggaaucguauaagcaauuuaaaacgcucauuagaauuaacucauuuucaugagaacuacccaugacguagaaaaacaaaucuacguuacucuuguacacgcacguaaggccaucgagcauuauaauuucggcguucgcccuguggguuuuguugaacagauucuucucgaaagucuucugcucuuucgcugugggaaauacguuuuugucguaguacuuugccaauauucgguuuccaucguuauccaagauagcuaugccuuuaauggcguucaaaguggguuccaauaacgagc

SEQ ID NO: 921 - RNA, 351 nt, artificial sequence
  synthetic construct
guacuuuaauaaugaccauuucagcuguucuuuggcugauugaaacaccugggcgacuguuugcuccccaaucggaaugucgucguuucuuaaagccacccucgauaccaccgaguucgaaucggcaucgaugauaaucccuccaucgcagauuucauccauggccaacaugacuauaucuaacgaaucuaaaacuacccucuucuccauauucuuccuuagaauuuggcucacggaaucguauaagcaauuuaaaacgcucauuagaauuaacucauuuucaugagaacuacccaugacguagaaaaacaaaucuacguuacucuuguacacgcacguaaggccaucgac

SEQ ID NO: 922 - RNA, 351 nt, artificial sequence
  synthetic construct
guaucuaacgaaucuaaaacuacccucuucuccauauucuuccuuagaauuuggcucacggaaucguauaagcaauuuaaaacgcucauuagaauuaacucauuuucaugagaacuacccaugacguagaaaaacaaaucuacguuacucuuguacacgcacguaaggccaucgagcauuauaauuucggcguucgcccuguggguuuuguugaacagauucuucucgaaagucuucugcucuuucgcugugggaaauacguuuuugucguaguacuuugccaauauucgguuuccaucguuauccaagauagcuaugccuuuaauggcguucaaaguggguuccaauaac

SEQ ID NO: 923 - RNA, 352 nt, artificial sequence
  synthetic construct
gacccucuucuccauauucuuccuuagaauuuggcucacggaaucguauaagcaauuuaaaacgcucauuagaauuaacucauuuucaugagaacuacccaugacguagaaaaacaaaucuacguuacucuuguacacgcacguaaggccaucgagcauuauaauuucggcguucgcccuguggguuuuguugaacagauucuucucgaaagucuucugcucuuucgcugugggaaauacguuuuugucguaguacuuugccaauauucgguuuccaucguuauccaagauagcuaugccuuuaauggcguucaaaguggguuccaauaacgagccuuccauuagugaauuc

SEQ ID NO: 924 - RNA, 351 nt, artificial sequence
  synthetic construct
gagcuguucuuuggcugauugaaacaccugggcgacuguuugcuccccaaucggaaugucgucguuucuuaaagccacccucgauaccaccgaguucgaaucggcaucgaugauaaucccuccaucgcagauuucauccauggccaacaugacuauaucuaacgaaucuaaaacuacccucuucuccauauucuuccuuagaauuuggcucacggaaucguauaagcaauuuaaaacgcucauuagaauuaacucauuuucaugagaacuacccaugacguagaaaaacaaaucuacguuacucuuguacacgcacguaaggccaucgagcauuauaauuucggcguucgc

SEQ ID NO: 925 - RNA, 352 nt, artificial sequence
  synthetic construct
guucgucucuucuaaaacgcccaguaggucuaauaguauuuuguacgauuuuuugcugucuuucugguuguuggaaauuaaaucguuggugagagggauuauuucguaccgaaauccaauaauguggaucaaaauuaggaaauauuuguaugucaauaaagaguuguuuccguaugaaacaacacacgcgugaaacaucaguuuaaaauaauguucagaggauuuuuuguucgauucgauaagguuuugaagaugcuucaguaaaauaucgaacccaaaguacuccccaucgucugguuugaaaauuucguugacaaaaugcucgaacuucuucugguuguuaugaaauaac

SEQ ID NO: 926 - RNA, 351 nt, artificial sequence
  synthetic construct
guaacucucucauacugcgccagaauaucagcaacuaaauacauagcgauucuggccauauccuucugaugcuccaccaaacucuucguuaauuucuccaacugguaagcacaaucggacaaaucgcugauaaaaugcucguuucguucuuuguuggaaucccccuucagacacaacacucucaacaaggcccuguauuguugcaaauaaggcggcaaucuauccaugacuaaagcuuuucugaauuugagcaaauucgacagcaaagaaaccagcaaauuguaaaaagaaacgaacgaaagaggcuccuuuuccagcaaaguaguuacgcuuaguaucagcaaauccauc

SEQ ID NO: 927 - RNA, 351 nt, artificial sequence
  synthetic construct
gauuuuuaaaaaggaccucauuaagcugcaauuauggguuuuguuuaguagcgauuuuccgaacguuuucaaaauaucuugcaauuccuggaggcauuuuuuaguuuuuucuacuacauucgaagccacugugugcucugcuacucuuaugcuggacaaaaaugugcaaaucaacucgcugagaagcuccauauguaugcaauacacauccucacuaguuuccuucucuagcugcuugaucaaagcauucaauaacguuuugaauacguuuaucaccugccaacuggcuaaaguuuguauauuuuucguaaacgauaccaaaaucuucuuaguaaaaauauucucaacagc

SEQ ID NO: 928 - RNA, 352 nt, artificial sequence
  synthetic construct
guaauucuaaauguacaagcgaauugcucagcaaacuuuccacuccucguugcaaacgauugguuuucacaggguugauauuagcagugauaauggacucccacguuuucaggaagcuuacauaauuuuuauaauuauucucuuuaagugccugauuagacagaauugcuagaucuacaauaaugcaauugaauuguucguuggacaucaaacaaaccaucaggaacaccaauugcgaauacuccucaauucuaguaaaaacuuuaucguuguuuuugcauaaauuccaaauuuuuauguacagcucaucgucgaauuccuugauuuuaguuuuguuguuuaacacuguauc

SEQ ID NO: 929 - RNA, 352 nt, artificial sequence
  synthetic construct
guaacacuguauugaacagcaauaaguacccgguuuugucgaaaucguccuucuucuccaaggcgaaauuaacauaagaauucaauacaucuagcaucuucgaaagcuucucgucuucguuuugcacgaauaauauuuucaaggcguacgcauauccgcauacuaaaugauuauuagguucacucguuaauacuaaaucgcaaauuccauugcaaaucgacgauuuguaguuuuccguaugguuuuugauuucuuuggggaccuucauuuuuuuuaacuuguuaacggcauuuauaauuauaauuccgcauugcaaguagacaggauuucgcaaguuauuuguaaugugcuc

SEQ ID NO: 930 - RNA, 351 nt, artificial sequence
  synthetic construct
guaagcuuuaccagugaaccuguaguauuucuuauaauucucauacauuacuuugaaaauuucuguggaagcgcuggacaaaacccucauuaaacacgaaacagcgugcugaucacagaugguuaucaaacuauaaaugcaguuguucagaugcauuuugauauugggauaaaucguaacucucucauacugcgccagaauaucagcaacuaaauacauagcgauucuggccauauccuucugaugcuccaccaaacucuucguuaauuucuccaacugguaagcacaaucggacaaaucgcugauaaaaugcucguuucguucuuuguuggaaucccccuucagacacac

SEQ ID NO: 931 - RNA, 351 nt, artificial sequence
  synthetic construct
gugcaggauguuuucgaauaacuccugaucauauugggauaauucuaaauguacaagcgaauugcucagcaaacuuuccacuccucguugcaaacgauugguuuucacaggguugauauuagcagugauaauggacucccacguuuucaggaagcuuacauaauuuuuauaauuauucucuuuaagugccugauuagacagaauugcuagaucuacaauaaugcaauugaauuguucguuggacaucaaacaaaccaucaggaacaccaauugcgaauacuccucaauucuaguaaaaacuuuaucguuguuuuugcauaaauuccaaauuuuuauguacagcucaucguc

SEQ ID NO: 932 - RNA, 351 nt, artificial sequence
  synthetic construct
gcgaacuuucuguguguacaauuuguacaauaauugcuugcaagguacuucuccgaaguuguugauucucucugaaaucgaacaccaaucuucguguguuaaauauggauguaaauaaguaauguugcuagccauacaauuguauucuaaagcuuucuucuguguagaauccugagggcucgaguaauauuucaguaugauccccauuucagcccaauggaaggcuauuuuuaaaaaggaccucauuaagcugcaauuauggguuuuguuuaguagcgauuuuccgaacguuuucaaaauaucuugcaauuccuggaggcauuuuuuaguuuuuucuacuacauucgaagc

SEQ ID NO: 933 - RNA, 351 nt, artificial sequence
  synthetic construct
gacacgauuuucucagcuaaaauaauccuacuuuccggaucuaaaguaugcauuaaauuguuaguuaagaauuuauccugcaggauauccuuccaauuauucuccaaaucugaugucagauaccucgauaaauccacuaacacuucguugguaaguuuuuguucgaauaugcacaaugcacgaacuuucuguguguacaauuuguacaauaauugcuugcaagguacuucuccgaaguuguugauucucucugaaaucgaacaccaaucuucguguguuaaauauggauguaaauaaguaauguugcuagccauacaauuguauucuaaagcuuucuucuguguagaaucc

SEQ ID NO: 934 - RNA, 352 nt, artificial sequence
  synthetic construct
gacuuugugcuguacgaggugagucacuguggaacauucuucccuuuuaacuucagguugugaaguaacuuucucgaugauaccuucuacgauuuguuuuauacucugcguaucaauuucauuucuauugauuccuuuaaaauaggcagaagacaccaaauuuuccaguguuuuccauauuaaaucgaccucauuuuguuguaaaauccacuuuaagaggauaauuuuacauguuacaggcaauucgguagacuugaaaaaauugucuacauacugcaauuuaguugugaacguuucuuccucguuguuuaagugaauuaauaauucuuccucuagagucauuuuagauauc

SEQ ID NO: 935 - RNA, 351 nt, artificial sequence
  synthetic construct
gcgaauugcucagcaaacuuuccacuccucguugcaaacgauugguuuucacaggguugauauuagcagugauaauggacucccacguuuucaggaagcuuacauaauuuuuauaauuauucucuuuaagugccugauuagacagaauugcuagaucuacaauaaugcaauugaauuguucguuggacaucaaacaaaccaucaggaacaccaauugcgaauacuccucaauucuaguaaaaacuuuaucguuguuuuugcauaaauuccaaauuuuuauguacagcucaucgucgaauuccuugauuuuaguuuuguuguuuaacacuguauugaacagcaauaaguacc

SEQ ID NO: 936 - RNA, 351 nt, artificial sequence
  synthetic construct
gccaaaguucuccaguacuucuccgaaucuaugcaaauuccccauccuaaccgccuggguuaacuggaaguaaggggccaacgagugccucaugcuggccugccugaagaucugccuuucugguauaucccccaacagcaacucgacuacaacgguaagcuuuugcacuguuugucggaagcccaucgcagcauucuggggcgauuuccucauagcuugaauuagguguuuaugcgcaacgcuguacuccaaucgugcagcuuuaauucgaccuaaauaguacaaaaaccuggcccauucguuguugcuagccguuucgggauagacgcauuuauucacuaacuuaucagc

SEQ ID NO: 937 - RNA, 351 nt, artificial sequence
  synthetic construct
guuucacacucugauuaugcaggucuaaacaaaacgauauccucugaugaaaagcgaguugcggcucuuuagugcaauaaauaucugugcuuuccuugcuucucauauaccccccuuguggauccaagauagccucgauuacaccaucccgaauagcuuuagcaacgauaaauucugcaucuucagcgcaauccaggccgaguuucuuagcuauaucuugcggggauauucucgaguaagacaacccgauagaucuaauggcuguuuuuauaacguugugacgcagccguaguauuaaaguaaaaguaugauccaaucuaaauugcggcccaaaguucuccaguacuucuc

SEQ ID NO: 938 - RNA, 352 nt, artificial sequence
  synthetic construct
guaaauucugcaucuucagcgcaauccaggccgaguuucuuagcuauaucuugcggggauauucucgaguaagacaacccgauagaucuaauggcuguuuuuauaacguugugacgcagccguaguauuaaaguaaaaguaugauccaaucuaaauugcggcccaaaguucuccaguacuucuccgaaucuaugcaaauuccccauccuaaccgccuggguuaacuggaaguaaggggccaacgagugccucaugcuggccugccugaagaucugccuuucugguauaucccccaacagcaacucgacuacaacgguaagcuuuugcacuguuugucggaagcccaucgcac

SEQ ID NO: 939 - RNA, 350 nt, artificial sequence
  synthetic construct
gauuaugcaggucuaaacaaaacgauauccucugaugaaaagcgaguugcggcucuuuagugcaauaaauaucugugcuuuccuugcuucucauauaccccccuuguggauccaagauagccucgauuacaccaucccgaauagcuuuagcaacgauaaauucugcaucuucagcgcaauccaggccgaguuucuuagcuauaucuugcggggauauucucgaguaagacaacccgauagaucuaauggcuguuuuuauaacguugugacgcagccguaguauuaaaguaaaaguaugauccaaucuaaauugcggcccaaaguucuccaguacuucuccgaaucuaugc

SEQ ID NO: 940 - RNA, 351 nt, artificial sequence
  synthetic construct
gaauucuuucccguacgccuucgggggauaucucauagcuuucacacucugauuaugcaggucuaaacaaaacgauauccucugaugaaaagcgaguugcggcucuuuagugcaauaaauaucugugcuuuccuugcuucucauauaccccccuuguggauccaagauagccucgauuacaccaucccgaauagcuuuagcaacgauaaauucugcaucuucagcgcaauccaggccgaguuucuuagcuauaucuugcggggauauucucgaguaagacaacccgauagaucuaauggcuguuuuuauaacguugugacgcagccguaguauuaaaguaaaaguaugauc

SEQ ID NO: 941 - RNA, 351 nt, artificial sequence
  synthetic construct
gccuggguuaacuggaaguaaggggccaacgagugccucaugcuggccugccugaagaucugccuuucugguauaucccccaacagcaacucgacuacaacgguaagcuuuugcacuguuugucggaagcccaucgcagcauucuggggcgauuuccucauagcuugaauuagguguuuaugcgcaacgcuguacuccaaucgugcagcuuuaauucgaccuaaauaguacaaaaaccuggcccauucguuguugcuagccguuucgggauagacgcauuuauucacuaacuuaucagcuugaucguagagcgaguagugcaaguaauuucuuagcagacaauuaaucagc

SEQ ID NO: 942 - RNA, 351 nt, artificial sequence
  synthetic construct
guaaggaaauccaucaucaucuuccucggccauuucuuucgcuagcuccaaaucuuguugcucccuuucucgccucuccucggcagacuccaauucuuucccguacgccuucgggggauaucucauagcuuucacacucugauuaugcaggucuaaacaaaacgauauccucugaugaaaagcgaguugcggcucuuuagugcaauaaauaucugugcuuuccuugcuucucauauaccccccuuguggauccaagauagccucgauuacaccaucccgaauagcuuuagcaacgauaaauucugcaucuucagcgcaauccaggccgaguuucuuagcuauaucuugcgc

SEQ ID NO: 943 - RNA, 352 nt, artificial sequence
  synthetic construct
gacgucccgcucggcgacgggguacauuugauugaugaggcuccugaggacgguuccguucaguuugcgucugguguucggcaagcagcgcagcacucucaauauaaaucgguuuucuuugcugcucacugccuucucgaucugccuggcauguucgcgaauuuccaagacgcuuuguaagucgaugucacgcuugcugucuccagcuucuaagccugccgggcugucugcguuuuucaucucgacgucgguuucuacgcccauuuuuauucgaauauuuggaaaacaagaauuaguugcugaaaaauuguuuuucgcuguguaacgaugacaauuggcguguugacauugc

SEQ ID NO: 944 - RNA, 351 nt, artificial sequence
  synthetic construct
gcccuuucucgccucuccucggcagacuccaauucuuucccguacgccuucgggggauaucucauagcuuucacacucugauuaugcaggucuaaacaaaacgauauccucugaugaaaagcgaguugcggcucuuuagugcaauaaauaucugugcuuuccuugcuucucauauaccccccuuguggauccaagauagccucgauuacaccaucccgaauagcuuuagcaacgauaaauucugcaucuucagcgcaauccaggccgaguuucuuagcuauaucuugcggggauauucucgaguaagacaacccgauagaucuaauggcuguuuuuauaacguugugacgc

SEQ ID NO: 945 - RNA, 352 nt, artificial sequence
  synthetic construct
gcccaaaguucuccaguacuucuccgaaucuaugcaaauuccccauccuaaccgccuggguuaacuggaaguaaggggccaacgagugccucaugcuggccugccugaagaucugccuuucugguauaucccccaacagcaacucgacuacaacgguaagcuuuugcacuguuugucggaagcccaucgcagcauucuggggcgauuuccucauagcuugaauuagguguuuaugcgcaacgcuguacuccaaucgugcagcuuuaauucgaccuaaauaguacaaaaaccuggcccauucguuguugcuagccguuucgggauagacgcauuuauucacuaacuuaucagc

SEQ ID NO: 946 - RNA, 352 nt, artificial sequence
  synthetic construct
gaaauccaucaucaucuuccucggccauuucuuucgcuagcuccaaaucuuguugcucccuuucucgccucuccucggcagacuccaauucuuucccguacgccuucgggggauaucucauagcuuucacacucugauuaugcaggucuaaacaaaacgauauccucugaugaaaagcgaguugcggcucuuuagugcaauaaauaucugugcuuuccuugcuucucauauaccccccuuguggauccaagauagccucgauuacaccaucccgaauagcuuuagcaacgauaaauucugcaucuucagcgcaauccaggccgaguuucuuagcuauaucuugcggggauac

SEQ ID NO: 947 - RNA, 350 nt, artificial sequence
  synthetic construct
gcaacaaauugaaaauauccugcaauugauagaugaucugaugguugaugggcagcuuguuaucgcacacuugcaucaaauagucucuuauaucuuucaauugcaaaugcaacccuuuaaggccuaauaacugauuaguaauccucugagauaaaguucccacuguagugucuuugauaucucuuaguaaauguucuacuccgacuucuucagcuucuucugcgccuauuucgcucgggacguguucaaacguuuuagaugugggugagccaucaucguggacuucuucuaccgcuugguaugcuucaguaggaagccccagaucuuuagguuucgcaucuauaaucacc

SEQ ID NO: 948 - RNA, 351 nt, artificial sequence
  synthetic construct
gucuucugcgucucuguuggugaguuuguuguugauuagguugugcaaugcaacgauagaucgaacgagagcuccuaaauaaacuacaagcauuugaucguuauuuuuaacauaaaacgaauuguugaacgcauccugauuuauaucgggcaacaaauugaaaauauccugcaauugauagaugaucugaugguugaugggcagcuuguuaucgcacacuugcaucaaauagucucuuauaucuuucaauugcaaaugcaacccuuuaaggccuaauaacugauuaguaauccucugagauaaaguucccacuguagugucuuugauaucucuuaguaaauguucuacucc

SEQ ID NO: 949 - RNA, 351 nt, artificial sequence
  synthetic construct
guauuucgcucgggacguguucaaacguuuuagaugugggugagccaucaucguggacuucuucuaccgcuugguaugcuucaguaggaagccccagaucuuuagguuucgcaucuauaaucaccaagacugaauuggggcaguaucuucgaacuaauucguugauagcgaugucguuuugguguaauuuaggaccggugugguaccaaccaacgacgcguucucuagcguugacuuucuuaaacaugccguacauguuuuccagguagucgugguccaagaaccauacagauuugucuuugucguccucaucgaaagggacugcgaaacuguuggacacaucuaagacuc

SEQ ID NO: 950 - RNA, 352 nt, artificial sequence
  synthetic construct
guaucuucgaacuaauucguugauagcgaugucguuuugguguaauuuaggaccggugugguaccaaccaacgacgcguucucuagcguugacuuucuuaaacaugccguacauguuuuccagguagucgugguccaagaaccauacagauuugucuuugucguccucaucgaaagggacugcgaaacuguuggacacaucuaagacuccuuuggcccuccagcaaccgaguagaacaccgacaacacgcuuuugauugccgauuuugcccauccgauugaaaugguccacuacgcugagaagcaccagcgggugcacuaucaccuuagucguuguaaccucuguacucggc

SEQ ID NO: 951 - RNA, 351 nt, artificial sequence
  synthetic construct
guauuuuuucuucucguccuucuucgcuuccuucucuuuguccguuuuuuccuuauccuugucuuugcuaucuuuauccuuguuguccuuuuucuccuccuuuuugccuucuucugcgucucuguuggugaguuuguuguugauuagguugugcaaugcaacgauagaucgaacgagagcuccuaaauaaacuacaagcauuugaucguuauuuuuaacauaaaacgaauuguugaacgcauccugauuuauaucgggcaacaaauugaaaauauccugcaauugauagaugaucugaugguugaugggcagcuuguuaucgcacacuugcaucaaauagucucuuauauc

SEQ ID NO: 952 - RNA, 352 nt, artificial sequence
  synthetic construct
guuucuucucguccuucuucgcuuccuucucuuuguccguuuuuuccuuauccuugucuuugcuaucuuuauccuuguuguccuuuuucuccuccuuuuugccuucuucugcgucucuguuggugaguuuguuguugauuagguugugcaaugcaacgauagaucgaacgagagcuccuaaauaaacuacaagcauuugaucguuauuuuuaacauaaaacgaauuguugaacgcauccugauuuauaucgggcaacaaauugaaaauauccugcaauugauagaugaucugaugguugaugggcagcuuguuaucgcacacuugcaucaaauagucucuuauaucuuucac

SEQ ID NO: 953 - RNA, 352 nt, artificial sequence
  synthetic construct
guucuucucguccuucuucgcuuccuucucuuuguccguuuuuuccuuauccuugucuuugcuaucuuuauccuuguuguccuuuuucuccuccuuuuugccuucuucugcgucucuguuggugaguuuguuguugauuagguugugcaaugcaacgauagaucgaacgagagcuccuaaauaaacuacaagcauuugaucguuauuuuuaacauaaaacgaauuguugaacgcauccugauuuauaucgggcaacaaauugaaaauauccugcaauugauagaugaucugaugguugaugggcagcuuguuaucgcacacuugcaucaaauagucucuuauaucuuucaac

SEQ ID NO: 954 - RNA, 351 nt, artificial sequence
  synthetic construct
guauccuugucuuugcuaucuuuauccuuguuguccuuuuucuccuccuuuuugccuucuucugcgucucuguuggugaguuuguuguugauuagguugugcaaugcaacgauagaucgaacgagagcuccuaaauaaacuacaagcauuugaucguuauuuuuaacauaaaacgaauuguugaacgcauccugauuuauaucgggcaacaaauugaaaauauccugcaauugauagaugaucugaugguugaugggcagcuuguuaucgcacacuugcaucaaauagucucuuauaucuuucaauugcaaaugcaacccuuuaaggccuaauaacugauuaguaauccuc

SEQ ID NO: 955 - RNA, 352 nt, artificial sequence
  synthetic construct
guccuaaauaaacuacaagcauuugaucguuauuuuuaacauaaaacgaauuguugaacgcauccugauuuauaucgggcaacaaauugaaaauauccugcaauugauagaugaucugaugguugaugggcagcuuguuaucgcacacuugcaucaaauagucucuuauaucuuucaauugcaaaugcaacccuuuaaggccuaauaacugauuaguaauccucugagauaaaguucccacuguagugucuuugauaucucuuaguaaauguucuacuccgacuucuucagcuucuucugcgccuauuucgcucgggacguguucaaacguuuuagaugugggugagccauc

SEQ ID NO: 956 - RNA, 351 nt, artificial sequence
  synthetic construct
guaauaacugauuaguaauccucugagauaaaguucccacuguagugucuuugauaucucuuaguaaauguucuacuccgacuucuucagcuucuucugcgccuauuucgcucgggacguguucaaacguuuuagaugugggugagccaucaucguggacuucuucuaccgcuugguaugcuucaguaggaagccccagaucuuuagguuucgcaucuauaaucaccaagacugaauuggggcaguaucuucgaacuaauucguugauagcgaugucguuuugguguaauuuaggaccggugugguaccaaccaacgacgcguucucuagcguugacuuucuuaaacaugc

SEQ ID NO: 957 - RNA, 352 nt, artificial sequence
  synthetic construct
guuuuuccucuaauaauugcuccauuguauuaacauguuugcaccaaucauugagucuuguuaccauacuggagaucugagugcgaucuaaaacucucgguugaacccaugucauguuuaccguacuggcaaccugaucaauugccccuuuaacuaagccuugugaaagcgccuucauuaccagcagcucaauuucauugagagguaaccucguuucuuuugaaauuuccgcaaauguuaacugccuguuaugggacggucuguuaaaugucaucuccaucagacauaauaaggauaucuucugucuuaagaauaguuccucgguggccaaaucggcuauagacgaccacuc

SEQ ID NO: 958 - RNA, 352 nt, artificial sequence
  synthetic construct
guuccucuaauaauugcuccauuguauuaacauguuugcaccaaucauugagucuuguuaccauacuggagaucugagugcgaucuaaaacucucgguugaacccaugucauguuuaccguacuggcaaccugaucaauugccccuuuaacuaagccuugugaaagcgccuucauuaccagcagcucaauuucauugagagguaaccucguuucuuuugaaauuuccgcaaauguuaacugccuguuaugggacggucuguuaaaugucaucuccaucagacauaauaaggauaucuucugucuuaagaauaguuccucgguggccaaaucggcuauagacgaccacugagc

SEQ ID NO: 959 - RNA, 351 nt, artificial sequence
  synthetic construct
guacaaaguuaauauuucacuggcuuuuuccucuaauaauugcuccauuguauuaacauguuugcaccaaucauugagucuuguuaccauacuggagaucugagugcgaucuaaaacucucgguugaacccaugucauguuuaccguacuggcaaccugaucaauugccccuuuaacuaagccuugugaaagcgccuucauuaccagcagcucaauuucauugagagguaaccucguuucuuuugaaauuuccgcaaauguuaacugccuguuaugggacggucuguuaaaugucaucuccaucagacauaauaaggauaucuucugucuuaagaauaguuccucgguggc

SEQ ID NO: 960 - RNA, 350 nt, artificial sequence
  synthetic construct
gucuuuucuaggaaagcgaucgcgucuuucgguuccuuguacuguucgacgacaauggccgcuauuucgaccaaagacaaaggauugauuuuauuuucgaacguuugaauaaaauugugauacagcuggauuagguuguccgcuuucuguaauucugguuucuuuauaaacacuaguaauuugaggguuaguugaugccauaauuuuuuauuauggagcuccucaaguucugcccacucagagcccaauuccuucggacuuucuuuuuguuguuuagcaagauaaucacuaacauuagacgguugcaccgcagcugcagccauuuucugugaugacaagacaaaaauuuc

SEQ ID NO: 961 - RNA, 350 nt, artificial sequence
  synthetic construct
gagguaaccucguuucuuuugaaauuuccgcaaauguuaacugccuguuaugggacggucuguuaaaugucaucuccaucagacauaauaaggauaucuucugucuuaagaauaguuccucgguggccaaaucggcuauagacgaccacugaguuuucauggcuucgaauuuccuuauguuuccggaauugaaggcguacaaaagcucgaugagccaagcauucucgguugccuucagagacucuaauacaggaugggccagaagcucuccgagauuguaaacucccucucccagcaaagcugcuaagcccaagaaaaacgcaugcugcacuuucacuucggucuucaac

SEQ ID NO: 962 - RNA, 352 nt, artificial sequence
  synthetic construct
gagguaaccucguuucuuuugaaauuuccgcaaauguuaacugccuguuaugggacggucuguuaaaugucaucuccaucagacauaauaaggauaucuucugucuuaagaauaguuccucgguggccaaaucggcuauagacgaccacugaguuuucauggcuucgaauuuccuuauguuuccggaauugaaggcguacaaaagcucgaugagccaagcauucucgguugccuucagagacucuaauacaggaugggccagaagcucuccgagauuguaaacucccucucccagcaaagcugcuaagcccaagaaaaacgcaugcugcacuuucacuucggucuucaacgc

SEQ ID NO: 963 - RNA, 350 nt, artificial sequence
  synthetic construct
gcucgaugagccaagcauucucgguugccuucagagacucuaauacaggaugggccagaagcucuccgagauuguaaacucccucucccagcaaagcugcuaagcccaagaaaaacgcaugcugcacuuucacuucggucuucaacgauuccacaucuaugcagcccaaauaccucaaagcggugcgauaauauugcgcauggucuccuugaauucuguaauauugcgaggcgaguaaauaaaaucucccguguacugggguaaccccguccgcauuaucaaaggucgcuucgaccuccucgaugaucuuuuugguggugucuaaaucguuuaacuuaucaagguagauc

SEQ ID NO: 964 - RNA, 351 nt, artificial sequence
  synthetic construct
gauugcgaggcgaguaaauaaaaucucccguguacugggguaaccccguccgcauuaucaaaggucgcuucgaccuccucgaugaucuuuuugguggugucuaaaucguuuaacuuaucaagguagaucuguccuucgaggacuuugcacagguuuugggcguccggguugauuuucacuuuggguucagucuuuucuaggaaagcgaucgcgucuuucgguuccuuguacuguucgacgacaauggccgcuauuucgaccaaagacaaaggauugauuuuauuuucgaacguuugaauaaaauugugauacagcuggauuagguuguccgcuuucuguaauucugguuuc

SEQ ID NO: 965 - RNA, 352 nt, artificial sequence
  synthetic construct
gagggcaucuaauuccugcuugcuuucuacgaaucucgaucugucguuagcgucaauaagaaauacgauagcaucuacggcugggaaguaauccuuccacacucuucgggcuugcgaauggccuccuagaucgaacgugguaaaccucauguuuccgauggacaauuccucggaggucggaugcaaugugggcaagugcugggccagucuaucaucuuuaagcauauguaauaaggucguuuuaccagcguuguccaguccuaaaaagagcaauuuuccggacuucuuccauaauccuaaguaucccagcacucccgugaaccaaucccauaugaacauuucgauuaauugc

SEQ ID NO: 966 - RNA, 350 nt, artificial sequence
  synthetic construct
gccuagaaucaacacggggcaauuggcuagagucucguccguuaacagggcaucuaauuccugcuugcuuucuacgaaucucgaucugucguuagcgucaauaagaaauacgauagcaucuacggcugggaaguaauccuuccacacucuucgggcuugcgaauggccuccuagaucgaacgugguaaaccucauguuuccgauggacaauuccucggaggucggaugcaaugugggcaagugcugggccagucuaucaucuuuaagcauauguaauaaggucguuuuaccagcguuguccaguccuaaaaagagcaauuuuccggacuucuuccauaauccuaaguauc

SEQ ID NO: 967 - RNA, 350 nt, artificial sequence
  synthetic construct
guaaucaauguacugcgccaaccaacgaaaacccuccccguaucccugccucuucaauauggagcacaugaaaagcucgagaggccuuccggguagaucggaccgagcgacuuuaccuuuaccggucguuuggccauacaacgaguaaacguuucgcaauucauccucagaggcggcguccggcagaucgauuuuauugccuagaaucaacacggggcaauuggcuagagucucguccguuaacagggcaucuaauuccugcuugcuuucuacgaaucucgaucugucguuagcgucaauaagaaauacgauagcaucuacggcugggaaguaauccuuccacacucuuc

SEQ ID NO: 968 - RNA, 352 nt, artificial sequence
  synthetic construct
guuuauugccuagaaucaacacggggcaauuggcuagagucucguccguuaacagggcaucuaauuccugcuugcuuucuacgaaucucgaucugucguuagcgucaauaagaaauacgauagcaucuacggcugggaaguaauccuuccacacucuucgggcuugcgaauggccuccuagaucgaacgugguaaaccucauguuuccgauggacaauuccucggaggucggaugcaaugugggcaagugcugggccagucuaucaucuuuaagcauauguaauaaggucguuuuaccagcguuguccaguccuaaaaagagcaauuuuccggacuucuuccauaauccuac

SEQ ID NO: 969 - RNA, 352 nt, artificial sequence
  synthetic construct
guauugccuagaaucaacacggggcaauuggcuagagucucguccguuaacagggcaucuaauuccugcuugcuuucuacgaaucucgaucugucguuagcgucaauaagaaauacgauagcaucuacggcugggaaguaauccuuccacacucuucgggcuugcgaauggccuccuagaucgaacgugguaaaccucauguuuccgauggacaauuccucggaggucggaugcaaugugggcaagugcugggccagucuaucaucuuuaagcauauguaauaaggucguuuuaccagcguuguccaguccuaaaaagagcaauuuuccggacuucuuccauaauccuaagc

SEQ ID NO: 970 - RNA, 351 nt, artificial sequence
  synthetic construct
gugacggucgacguagaucuguccuucgguaauauaaccggucaaaucgggaaucgggugaguaauaucgucguugggcauggucaagauggggauuugggugauggagccguugcggcccuccacacguccggcucguucguaaaugguggccaaaucgguguacauguaaccggggaaaccacgucuaccgggcacuucuucccuggcggcggauaccucacgcaaagcuucagcguacgaagacauaucagucaauaugaccaacacgugcuucucgcauugauaggccaaaaauucggcagccguuagagccaaacggggcgugaugauucucucaauaguaggauc

SEQ ID NO: 971 - RNA, 352 nt, artificial sequence
  synthetic construct
gagcugacggucgacguagaucuguccuucgguaauauaaccggucaaaucgggaaucgggugaguaauaucgucguugggcauggucaagauggggauuugggugauggagccguugcggcccuccacacguccggcucguucguaaaugguggccaaaucgguguacauguaaccggggaaaccacgucuaccgggcacuucuucccuggcggcggauaccucacgcaaagcuucagcguacgaagacauaucagucaauaugaccaacacgugcuucucgcauugauaggccaaaaauucggcagccguuagagccaaacggggcgugaugauucucucaauaguaggc

SEQ ID NO: 972 - RNA, 352 nt, artificial sequence
  synthetic construct
gucgccggugaauucgcacacgguguuuuuggcgucgauucccgaaguaccuucgaacacuuguacuacggcuuuggagccgcucaccuccaauacuugaccggaucguagacugccaucggccaguuugagcuggacgauuucguugaauuucggaaauuugacaucuucgaggauuaccaacgguccguugacaccagacacuguuuuguaagugagccucggcugggauacgaagucucuggacacggccaaaacgugcuccugugcggccuguuuugcguuuaacgucgauggguaagacaucuucucugcgugaagaacgauacgucuaacacaaaccgcaaaaaac

SEQ ID NO: 973 - RNA, 352 nt, artificial sequence
  synthetic construct
gaauauaaccggucaaaucgggaaucgggugaguaauaucgucguugggcauggucaagauggggauuugggugauggagccguugcggcccuccacacguccggcucguucguaaaugguggccaaaucgguguacauguaaccggggaaaccacgucuaccgggcacuucuucccuggcggcggauaccucacgcaaagcuucagcguacgaagacauaucagucaauaugaccaacacgugcuucucgcauugauaggccaaaaauucggcagccguuagagccaaacggggcgugaugauucucucaauaguaggaucguuggccaaauucaagaacaaacauacguc

SEQ ID NO: 974 - RNA, 351 nt, artificial sequence
  synthetic construct
gaaaucgggaaucgggugaguaauaucgucguugggcauggucaagauggggauuugggugauggagccguugcggcccuccacacguccggcucguucguaaaugguggccaaaucgguguacauguaaccggggaaaccacgucuaccgggcacuucuucccuggcggcggauaccucacgcaaagcuucagcguacgaagacauaucagucaauaugaccaacacgugcuucucgcauugauaggccaaaaauucggcagccguuagagccaaacggggcgugaugauucucucaauaguaggaucguuggccaaauucaagaacaaacauacguucuccaucgaacc

SEQ ID NO: 975 - RNA, 352 nt, artificial sequence
  synthetic construct
guagaaacgucagagugaucuuuccuggucauucccucgccgauggcggacuucaugagacgagacagcgacgguaagacguugaucgguggguaaauuugccuguugugcagcugacggucgacguagaucuguccuucgguaauauaaccggucaaaucgggaaucgggugaguaauaucgucguugggcauggucaagauggggauuugggugauggagccguugcggcccuccacacguccggcucguucguaaaugguggccaaaucgguguacauguaaccggggaaaccacgucuaccgggcacuucuucccuggcggcggauaccucacgcaaagcuucagcgc

SEQ ID NO: 976 - RNA, 352 nt, artificial sequence
  synthetic construct
guaugaaguucuucucgaacuuggucaggaacuccagguagagcaaaucgucgggcgucagggccuccucucccaccacggccuucaucgccuggacguccuuaccaauggcguagcaagcguacaacugguuagaaacgucagagugaucuuuccuggucauucccucgccgauggcggacuucaugagacgagacagcgacgguaagacguugaucgguggguaaauuugccuguugugcagcugacggucgacguagaucuguccuucgguaauauaaccggucaaaucgggaaucgggugaguaauaucgucguugggcauggucaagauggggauuugggugauggc

SEQ ID NO: 977 - RNA, 352 nt, artificial sequence
  synthetic construct
gcagcugacggucgacguagaucuguccuucgguaauauaaccggucaaaucgggaaucgggugaguaauaucgucguugggcauggucaagauggggauuugggugauggagccguugcggcccuccacacguccggcucguucguaaaugguggccaaaucgguguacauguaaccggggaaaccacgucuaccgggcacuucuucccuggcggcggauaccucacgcaaagcuucagcguacgaagacauaucagucaauaugaccaacacgugcuucucgcauugauaggccaaaaauucggcagccguuagagccaaacggggcgugaugauucucucaauaguagc

SEQ ID NO: 978 - RNA, 350 nt, artificial sequence
  synthetic construct
guaauauaaccggucaaaucgggaaucgggugaguaauaucgucguugggcauggucaagauggggauuugggugauggagccguugcggcccuccacacguccggcucguucguaaaugguggccaaaucgguguacauguaaccggggaaaccacgucuaccgggcacuucuucccuggcggcggauaccucacgcaaagcuucagcguacgaagacauaucagucaauaugaccaacacgugcuucucgcauugauaggccaaaaauucggcagccguuagagccaaacggggcgugaugauucucucaauaguaggaucguuggccaaauucaagaacaaacauac

SEQ ID NO: 979 - RNA, 351 nt, artificial sequence
  synthetic construct
gugaguaauaucgucguugggcauggucaagauggggauuugggugauggagccguugcggcccuccacacguccggcucguucguaaaugguggccaaaucgguguacauguaaccggggaaaccacgucuaccgggcacuucuucccuggcggcggauaccucacgcaaagcuucagcguacgaagacauaucagucaauaugaccaacacgugcuucucgcauugauaggccaaaaauucggcagccguuagagccaaacggggcgugaugauucucucaauaguaggaucguuggccaaauucaagaacaaacauacguucuccaucgaaccguucuccucgaaauc

SEQ ID NO: 980 - RNA, 351 nt, artificial sequence
  synthetic construct
guagucuuucaacauagcaggcuccucuuuaaugcuguccuuaauuuucucugcgggagccgccaccgaacaaccggagcucguucccaaaaccguuuucacuguucccgccguguugguguugucguucauuuucccuuccucagacuucucguuuuggcucugauuaccauaauacugucgguuggguguuuuguuggauguauuccuaugcuuuugauucgcugaauucugcuguacuuggaaauuuacgggucucugaauaggcgucggauaccuuugcauauuagagcuuuggggcccgccuacgccuugauacaaauuauauuucuguugggccgucgggcucgc

SEQ ID NO: 981 - RNA, 351 nt, artificial sequence
  synthetic construct
gcauccggaguguccuucccuugggcgaaaacguucgaauccagaggcgugccggagaacccgaucugauucucgucguucuccuguucggaugucucccacacuuuuuucaccgacgcgaucuuguaauccaaacugucgaccguauuguuaccgccggucaucguauggauggguuucgaggcgaaguucuucgaacucuuguccucggcgaauugcagaucggcggugaaaaaguccaauuucaugucggccgaguccuccuugaacagcugcagcggcaugcuguccgauuuguccggcuucgcuugcagcagaucguucauguuggguuuauuaaaacuagaaauc

SEQ ID NO: 982 - RNA, 351 nt, artificial sequence
  synthetic construct
guccggaguguccuucccuugggcgaaaacguucgaauccagaggcgugccggagaacccgaucugauucucgucguucuccuguucggaugucucccacacuuuuuucaccgacgcgaucuuguaauccaaacugucgaccguauuguuaccgccggucaucguauggauggguuucgaggcgaaguucuucgaacucuuguccucggcgaauugcagaucggcggugaaaaaguccaauuucaugucggccgaguccuccuugaacagcugcagcggcaugcuguccgauuuguccggcuucgcuugcagcagaucguucauguuggguuuauuaaaacuagaaaucac

SEQ ID NO: 983 - RNA, 352 nt, artificial sequence
  synthetic construct
gcggaguguccuucccuugggcgaaaacguucgaauccagaggcgugccggagaacccgaucugauucucgucguucuccuguucggaugucucccacacuuuuuucaccgacgcgaucuuguaauccaaacugucgaccguauuguuaccgccggucaucguauggauggguuucgaggcgaaguucuucgaacucuuguccucggcgaauugcagaucggcggugaaaaaguccaauuucaugucggccgaguccuccuugaacagcugcagcggcaugcuguccgauuuguccggcuucgcuugcagcagaucguucauguuggguuuauuaaaacuagaaaucacagc

SEQ ID NO: 984 - RNA, 351 nt, artificial sequence
  synthetic construct
guccuucccuugggcgaaaacguucgaauccagaggcgugccggagaacccgaucugauucucgucguucuccuguucggaugucucccacacuuuuuucaccgacgcgaucuuguaauccaaacugucgaccguauuguuaccgccggucaucguauggauggguuucgaggcgaaguucuucgaacucuuguccucggcgaauugcagaucggcggugaaaaaguccaauuucaugucggccgaguccuccuugaacagcugcagcggcaugcuguccgauuuguccggcuucgcuugcagcagaucguucauguuggguuuauuaaaacuagaaaucacagaauuguc

SEQ ID NO: 985 - RNA, 352 nt, artificial sequence
  synthetic construct
gaucguauuuacagggggcgugcugccgucgagcaggcuuuugucuugcagcggacugguuuuuccgaucaucuuuucauugccaggacucgugacuccuugcgaaggcgaaugagcggauuccaaagccuuaacggcguccauggacgguccgagcauaccgucgugcuccacuuuccucaacuggggccccaacggcuuaucccaagcgcacgucgacaugguggcgggcauaccguuaucuuucaucacguagacguucauguuguucauaucguugacgucuccgaucggaugguucugcuguuguugcugcugcugcugcuguuguuguuguuguaggauauuuauc

SEQ ID NO: 986 - RNA, 351 nt, artificial sequence
  synthetic construct
gacuguccggacggccggcguuucgcgaaccgggcgccgauuugaaguugguguuuucgaauauuaucguauuuacagggggcgugcugccgucgagcaggcuuuugucuugcagcggacugguuuuuccgaucaucuuuucauugccaggacucgugacuccuugcgaaggcgaaugagcggauuccaaagccuuaacggcguccauggacgguccgagcauaccgucgugcuccacuuuccucaacuggggccccaacggcuuaucccaagcgcacgucgacaugguggcgggcauaccguuaucuuucaucacguagacguucauguuguucauaucguugacgucuc

SEQ ID NO: 987 - RNA, 351 nt, artificial sequence
  synthetic construct
gauuaccauaauacugucgguuggguguuuuguuggauguauuccuaugcuuuugauucgcugaauucugcuguacuuggaaauuuacgggucucugaauaggcgucggauaccuuugcauauuagagcuuuggggcccgccuacgccuugauacaaauuauauuucuguugggccgucgggcucgauugcggcgggggauguuuauuguucugucucgauuucggcgagggaaucugaggaccuguauugaagaccgaagacaacaccuccuggcugcuggggcucuucaauugcugcggccugcccgauuggucgccgaucugguggcuguugacgcccuucauguagc

SEQ ID NO: 988 - RNA, 351 nt, artificial sequence
  synthetic construct
gcguugauuucauuuuguuuaucuaccccuucucucguuucaucuaauauucguucgauaucuucaauguucauagcagcauugaugguuuuaagggcuucauugccuguucuaaggccuucuacgacuuguguuuccacuugggcgaauucaauaucaccagccaaguuuucuagauuguucaguugauuaucaagcuuugauaggaguugcucuugguaccguuucuuuuuaagcaguaauuuagcccuguccuuuuggccauuauucaauaguuuuuuagcuaacucucuguccuuaccaagggauaauucuauucuccuuugguacuguuuuacuuuaucucucugc

SEQ ID NO: 989 - RNA, 351 nt, artificial sequence
  synthetic construct
guucguucgauaucuucaauguucauagcagcauugaugguuuuaagggcuucauugccuguucuaaggccuucuacgacuuguguuuccacuugggcgaauucaauaucaccagccaaguuuucuagauuguucaguugauuaucaagcuuugauaggaguugcucuugguaccguuucuuuuuaagcaguaauuuagcccuguccuuuuggccauuauucaauaguuuuuuagcuaacucucuguccuuaccaagggauaauucuauucuccuuugguacuguuuuacuuuaucucucugcuguuuuaauugcaauacagcuuugucuuguucuguuacucuacucggc

SEQ ID NO: 990 - RNA, 351 nt, artificial sequence
  synthetic construct
gauuccucuucaacagcugccucaucuucaucuguuaguuggccgcuaaguaauucguugauuucauuuuguuuaucuaccccuucucucguuucaucuaauauucguucgauaucuucaauguucauagcagcauugaugguuuuaagggcuucauugccuguucuaaggccuucuacgacuuguguuuccacuugggcgaauucaauaucaccagccaaguuuucuagauuguucaguugauuaucaagcuuugauaggaguugcucuugguaccguuucuuuuuaagcaguaauuuagcccuguccuuuuggccauuauucaauaguuuuuuagcuaacucucugucc

SEQ ID NO: 991 - RNA, 351 nt, artificial sequence
  synthetic construct
guaucuucaauguucauagcagcauugaugguuuuaagggcuucauugccuguucuaaggccuucuacgacuuguguuuccacuugggcgaauucaauaucaccagccaaguuuucuagauuguucaguugauuaucaagcuuugauaggaguugcucuugguaccguuucuuuuuaagcaguaauuuagcccuguccuuuuggccauuauucaauaguuuuuuagcuaacucucuguccuuaccaagggauaauucuauucuccuuugguacuguuuuacuuuaucucucugcuguuuuaauugcaauacagcuuugucuuguucuguuacucuacucggcuuuuucuuc

SEQ ID NO: 992 - RNA, 351 nt, artificial sequence
  synthetic construct
gauauucguucgauaucuucaauguucauagcagcauugaugguuuuaagggcuucauugccuguucuaaggccuucuacgacuuguguuuccacuugggcgaauucaauaucaccagccaaguuuucuagauuguucaguugauuaucaagcuuugauaggaguugcucuugguaccguuucuuuuuaagcaguaauuuagcccuguccuuuuggccauuauucaauaguuuuuuagcuaacucucuguccuuaccaagggauaauucuauucuccuuugguacuguuuuacuuuaucucucugcuguuuuaauugcaauacagcuuugucuuguucuguuacucuacuc

SEQ ID NO: 993 - RNA, 350 nt, artificial sequence
  synthetic construct
guucuaaggccuucuacgacuuguguuuccacuugggcgaauucaauaucaccagccaaguuuucuagauuguucaguugauuaucaagcuuugauaggaguugcucuugguaccguuucuuuuuaagcaguaauuuagcccuguccuuuuggccauuauucaauaguuuuuuagcuaacucucuguccuuaccaagggauaauucuauucuccuuugguacuguuuuacuuuaucucucugcuguuuuaauugcaauacagcuuugucuuguucuguuacucuacucggcuuuuucuucuuaccaaaaaugauacccaucguaaagucuguuugaaaauaugcuucucc

SEQ ID NO: 994 - RNA, 352 nt, artificial sequence
  synthetic construct
guuuaucuaccccuucucucguuucaucuaauauucguucgauaucuucaauguucauagcagcauugaugguuuuaagggcuucauugccuguucuaaggccuucuacgacuuguguuuccacuugggcgaauucaauaucaccagccaaguuuucuagauuguucaguugauuaucaagcuuugauaggaguugcucuugguaccguuucuuuuuaagcaguaauuuagcccuguccuuuuggccauuauucaauaguuuuuuagcuaacucucuguccuuaccaagggauaauucuauucuccuuugguacuguuuuacuuuaucucucugcuguuuuaauugcaauac

SEQ ID NO: 995 - RNA, 351 nt, artificial sequence
  synthetic construct
gaucuaauauucguucgauaucuucaauguucauagcagcauugaugguuuuaagggcuucauugccuguucuaaggccuucuacgacuuguguuuccacuugggcgaauucaauaucaccagccaaguuuucuagauuguucaguugauuaucaagcuuugauaggaguugcucuugguaccguuucuuuuuaagcaguaauuuagcccuguccuuuuggccauuauucaauaguuuuuuagcuaacucucuguccuuaccaagggauaauucuauucuccuuugguacuguuuuacuuuaucucucugcuguuuuaauugcaauacagcuuugucuuguucuguuacuc

SEQ ID NO: 996 - RNA, 352 nt, artificial sequence
  synthetic construct
guucaucuucuucuucuuuggcaguuucguuaacuuguacuucaggcuguuccauaggcacugugggcaaaucuucgcuaauuauugcugcuaauuccucuucaacagcugccucaucuucaucuguuaguuggccgcuaaguaauucguugauuucauuuuguuuaucuaccccuucucucguuucaucuaauauucguucgauaucuucaauguucauagcagcauugaugguuuuaagggcuucauugccuguucuaaggccuucuacgacuuguguuuccacuugggcgaauucaauaucaccagccaaguuuucuagauuguucaguugauuaucaagcuuugauac

SEQ ID NO: 997 - RNA, 351 nt, artificial sequence
  synthetic construct
gaauuccucuucaacagcugccucaucuucaucuguuaguuggccgcuaaguaauucguugauuucauuuuguuuaucuaccccuucucucguuucaucuaauauucguucgauaucuucaauguucauagcagcauugaugguuuuaagggcuucauugccuguucuaaggccuucuacgacuuguguuuccacuugggcgaauucaauaucaccagccaaguuuucuagauuguucaguugauuaucaagcuuugauaggaguugcucuugguaccguuucuuuuuaagcaguaauuuagcccuguccuuuuggccauuauucaauaguuuuuuagcuaacucucuguc

SEQ ID NO: 998 - RNA, 350 nt, artificial sequence
  synthetic construct
guaagcuaauacaggaaccuucucuuucucuuuuuccuuaguuuuugguuucuugaccuucuccuuuucuuccuccuccucauccguuacuacuuccccuucaucuucuucuucuuuggcaguuucguuaacuuguacuucaggcuguuccauaggcacugugggcaaaucuucgcuaauuauugcugcuaauuccucuucaacagcugccucaucuucaucuguuaguuggccgcuaaguaauucguugauuucauuuuguuuaucuaccccuucucucguuucaucuaauauucguucgauaucuucaauguucauagcagcauugaugguuuuaagggcuucauugc

SEQ ID NO: 999 - RNA, 352 nt, artificial sequence
  synthetic construct
gagcgagcccgacacccugagaguggcuaauugguucuucauuuguagcauuacggaguugaggugggcuuuggacguguagaucuuguugauggcuuugcgagaguugaugauuuccuuggcuaauaucaggcagguguccuugucguuuuucuuggcugcuuccuuuagggaucgcuugacuuuuucuucuucucgcuggauggaucguauuugccuuuccaguugguagccuuccuugcgcaguuugugguuccacucuguaaccaagucuuucggacuccucucaggcguuuucccgaaaagucccauguuucccgaguuuuugcuguuuuuaaaaaauacuaauguc

SEQ ID NO: 1000 - RNA, 352 nt, artificial sequence
  synthetic construct
guuucaucaucucuuuggacaugucuugcaucgucugcgccaccuccggcacgcguacgagccucugcaucgucugcaugaccuccguggauuuuugcagcgagcccgacacccugagaguggcuaauugguucuucauuuguagcauuacggaguugaggugggcuuuggacguguagaucuuguugauggcuuugcgagaguugaugauuuccuuggcuaauaucaggcagguguccuugucguuuuucuuggcugcuuccuuuagggaucgcuugacuuuuucuucuucucgcuggauggaucguauuugccuuuccaguugguagccuuccuugcgcaguuugugguc

SEQ ID NO: 1001 - RNA, 352 nt, artificial sequence
  synthetic construct
gaaucuccucuucguucuccuccuccucgggcuccuccaccgacgucgccggcaccggagucaccuucucggccagcuccugcggcggcagcggcgccuccccgaucuucccuuccguuaucucgaacaacacuuuaucuaucucgguuugcgccgcuuccuccaucuccucggaguccucgagauccuccaugguuucguccagcaucuccucgaugaugccggcuuucaucaucucuuuggacaugucuugcaucgucugcgccaccuccggcacgcguacgagccucugcaucgucugcaugaccuccguggauuuuugcagcgagcccgacacccugagaguggcuac

SEQ ID NO: 1002 - RNA, 352 nt, artificial sequence
  synthetic construct
gcagcgagcccgacacccugagaguggcuaauugguucuucauuuguagcauuacggaguugaggugggcuuuggacguguagaucuuguugauggcuuugcgagaguugaugauuuccuuggcuaauaucaggcagguguccuugucguuuuucuuggcugcuuccuuuagggaucgcuugacuuuuucuucuucucgcuggauggaucguauuugccuuuccaguugguagccuuccuugcgcaguuugugguuccacucuguaaccaagucuuucggacuccucucaggcguuuucccgaaaagucccauguuucccgaguuuuugcuguuuuuaaaaaauacuaaugc

SEQ ID NO: 1003 - RNA, 352 nt, artificial sequence
  synthetic construct
guucaucaucucuuuggacaugucuugcaucgucugcgccaccuccggcacgcguacgagccucugcaucgucugcaugaccuccguggauuuuugcagcgagcccgacacccugagaguggcuaauugguucuucauuuguagcauuacggaguugaggugggcuuuggacguguagaucuuguugauggcuuugcgagaguugaugauuuccuuggcuaauaucaggcagguguccuugucguuuuucuuggcugcuuccuuuagggaucgcuugacuuuuucuucuucucgcuggauggaucguauuugccuuuccaguugguagccuuccuugcgcaguuugugguuc

SEQ ID NO: 1004 - RNA, 352 nt, artificial sequence
  synthetic construct
gaaaucuccucuucguucuccuccuccucgggcuccuccaccgacgucgccggcaccggagucaccuucucggccagcuccugcggcggcagcggcgccuccccgaucuucccuuccguuaucucgaacaacacuuuaucuaucucgguuugcgccgcuuccuccaucuccucggaguccucgagauccuccaugguuucguccagcaucuccucgaugaugccggcuuucaucaucucuuuggacaugucuugcaucgucugcgccaccuccggcacgcguacgagccucugcaucgucugcaugaccuccguggauuuuugcagcgagcccgacacccugagaguggcuc

SEQ ID NO: 1005 - RNA, 352 nt, artificial sequence
  synthetic construct
guaauuucaucaaaacaagcgucgcaaacucuaaccucuuuuucuauuccguauuuggguaaaguagacguuuuagaagugcacuguccacaaaauacuugaccgcaggcucugcaaugguguuuucucuguagcacgcugaauugcacucugcaucuguggcaaacgucgccgucagcccauucuggagccguaucggacgaaaacaucgcguccgauucucgaagcgcagggaacuuacgaccuuccauuuucauuguauucauaagguccuugagagcaccaugcuuaggauuuuuucugaaugcgaaauuccaaguuugaaucaacucaagaaguuuacugcggacac

SEQ ID NO: 1006 - RNA, 352 nt, artificial sequence
  synthetic construct
guuguucuugucucaucugcauuucccucuccugcucuugaauccuuuggagcgccaacugucuuugguauugaagauauuccuguuucuuuuuccucauaacauccaacuugugcgccauuugcauuuggcgcauccucuccuguuccucagcuucucuucucaauuuuucguuauguucuucgcggagagcauccaaagccgcucuugcguccuucacuugggucauuuuauccuguaggcacucguaauggaugcggcugucgucgugcucuugaauauaaugaagcaaucgagaaugcauagcuguuauguucaugaacaaaguuuguacgcuagugucauucgcgac

SEQ ID NO: 1007 - RNA, 352 nt, artificial sequence
  synthetic construct
gaucaacucaagaaguuuacugcggacauuuucgugugggguaguuuucgacaacucauguaggaaaucacagaaugguuuagucguuaauucuucaugaaauacagugccacaauuuuuuaccaugcuuuccaaaaccaguagggcauauaaagcuguaugaggauuuucugaacugaguuucuucuuuaaugaauucaaagcaaauuucggcugaauaucaucuugucuaaucaagucgcacauuugcagcguagauaccaaauccugcuccauuaacaaauggcuagucgcuuuuucaagcaaaguaucaaaauuccuguggcgaaacauucugaaagaaaagugauuc

SEQ ID NO: 1008 - RNA, 351 nt, artificial sequence
  synthetic construct
gagcuacagcaacuugauucggcauauuuugagacgacaucauguguuguggaaauggauaaguguuguaguugcucauaggagguccagcguuagggggaaaagguuguccgugcacaggagagcuaauauaaccauauugaggcaucauauacugcuguuucuguuguucuugucucaucugcauuucccucuccugcucuugaauccuuuggagcgccaacugucuuugguauugaagauauuccuguuucuuuuuccucauaacauccaacuugugcgccauuugcauuuggcgcauccucuccuguuccucagcuucucuucucaauuuuucguuauguucuucgc

SEQ ID NO: 1009 - RNA, 351 nt, artificial sequence
  synthetic construct
gagagauucccaguaagaucuguuuagauauuuggcuaacuccguauucgauucuacuuguugagguggagauugcggucucucaacaggcaucgguucagcuuuugcagaauauaaaguaguuguagaucggguuuuuucuuuuucuuuagccuccgcuucagacuggcucaaagccaaugcuaacuguaauuccucuucuucccuuaauucuucgucgcuuuuuuuaggcggaucuuguuuuuguugugccaaagagcuguucaaauauucuucagguaaaucggucucgcuugauccccuggacuucggcgcagaugaggguuucauaauuucaucaaaacaagcguc

SEQ ID NO: 1010 - RNA, 352 nt, artificial sequence
  synthetic construct
guuucuguuguucuugucucaucugcauuucccucuccugcucuugaauccuuuggagcgccaacugucuuugguauugaagauauuccuguuucuuuuuccucauaacauccaacuugugcgccauuugcauuuggcgcauccucuccuguuccucagcuucucuucucaauuuuucguuauguucuucgcggagagcauccaaagccgcucuugcguccuucacuugggucauuuuauccuguaggcacucguaauggaugcggcugucgucgugcucuugaauauaaugaagcaaucgagaaugcauagcuguuauguucaugaacaaaguuuguacgcuagugucauc

SEQ ID NO: 1011 - RNA, 352 nt, artificial sequence
  synthetic construct
guuuccucauaacauccaacuugugcgccauuugcauuuggcgcauccucuccuguuccucagcuucucuucucaauuuuucguuauguucuucgcggagagcauccaaagccgcucuugcguccuucacuugggucauuuuauccuguaggcacucguaauggaugcggcugucgucgugcucuugaauauaaugaagcaaucgagaaugcauagcuguuauguucaugaacaaaguuuguacgcuagugucauucgcgauagaccucccucugcuggaguuacuuuucauucuguuaaugaaaauuucgacgugacccuuuaaagucuucaugaaaucuuccagaucguc

SEQ ID NO: 1012 - RNA, 351 nt, artificial sequence
  synthetic construct
guaaucgaaacuaauuaauucagcaguuugugcuuccccauucgauuugaucuguggacuagcaggaggagcuccaggcuguugcuguugaaacugaggcauucccugauucugcaucccuugauuuugaggaauauuucccggcaaagaaauccuacccugcugcggcacaccuugcggugguaacauuacucccugauucggaggaauauugccuugauguugcugcaugcccugcuguuggggcggcaaauuggguugauuuugcggcggcaucccuuguugcgguauuccugcauugggaggcauucccuguugguugcccggcauauugggcaauccugcugccac

SEQ ID NO: 1013 - RNA, 352 nt, artificial sequence
  synthetic construct
guuucugaaugcgaaauuccaaguuugaaucaacucaagaaguuuacugcggacauuuucgugugggguaguuuucgacaacucauguaggaaaucacagaaugguuuagucguuaauucuucaugaaauacagugccacaauuuuuuaccaugcuuuccaaaaccaguagggcauauaaagcuguaugaggauuuucugaacugaguuucuucuuuaaugaauucaaagcaaauuucggcugaauaucaucuugucuaaucaagucgcacauuugcagcguagauaccaaauccugcuccauuaacaaauggcuagucgcuuuuucaagcaaaguaucaaaauuccugugc

SEQ ID NO: 1014 - RNA, 352 nt, artificial sequence
  synthetic construct
gcugaagaggagcuguggccggcgcggauggacucauaggacgaucguuuuggucguuggauuuaagagauucccaguaagaucuguuuagauauuuggcuaacuccguauucgauucuacuuguugagguggagauugcggucucucaacaggcaucgguucagcuuuugcagaauauaaaguaguuguagaucggguuuuuucuuuuucuuuagccuccgcuucagacuggcucaaagccaaugcuaacuguaauuccucuucuucccuuaauucuucgucgcuuuuuuuaggcggaucuuguuuuuguugugccaaagagcuguucaaauauucuucagguaaaucggc

SEQ ID NO: 1015 - RNA, 352 nt, artificial sequence
  synthetic construct
guuucauuguauucauaagguccuugagagcaccaugcuuaggauuuuuucugaaugcgaaauuccaaguuugaaucaacucaagaaguuuacugcggacauuuucgugugggguaguuuucgacaacucauguaggaaaucacagaaugguuuagucguuaauucuucaugaaauacagugccacaauuuuuuaccaugcuuuccaaaaccaguagggcauauaaagcuguaugaggauuuucugaacugaguuucuucuuuaaugaauucaaagcaaauuucggcugaauaucaucuugucuaaucaagucgcacauuugcagcguagauaccaaauccugcuccauuac

SEQ ID NO: 1016 - RNA, 351 nt, artificial sequence
  synthetic construct
gucaucugauacuugcaucguauuuaauguagccaaccauucugaaaucuuuuguuugcccucaaaauccgacggcaaaaugcucaaucuguucaugguaucgacuaaaucucucacaucaggguguaacugauccauagaacgaauaucuaaucucaauuuguccauuacaguaaugaauagggacacaauaucagcaauacaucuacuaguauuucccuuaucaucuuuaauaguaauaggucugucuuccuuaauucuuucuagggcagccgggcaaucaagccuauauuucuuaacgaaagcaucaacaguaggaaacucaucuccauuaacuugucuaaaugcugc

SEQ ID NO: 1017 - RNA, 352 nt, artificial sequence
  synthetic construct
guaaaucucucacaucaggguguaacugauccauagaacgaauaucuaaucucaauuuguccauuacaguaaugaauagggacacaauaucagcaauacaucuacuaguauuucccuuaucaucuuuaauaguaauaggucugucuuccuuaauucuuucuagggcagccgggcaaucaagccuauauuucuuaacgaaagcaucaacaguaggaaacucaucuccauuaacuugucuaaaugcugcuuuguauugaacuaguagcuuacuacaagcaccaguauacucuuuggcaacaacacaaucccuaauguaugccuuuucaagcuguugcaauguguugauaacugc

SEQ ID NO: 1018 - RNA, 351 nt, artificial sequence
  synthetic construct
gauagggacacaauaucagcaauacaucuacuaguauuucccuuaucaucuuuaauaguaauaggucugucuuccuuaauucuuucuagggcagccgggcaaucaagccuauauuucuuaacgaaagcaucaacaguaggaaacucaucuccauuaacuugucuaaaugcugcuuuguauugaacuaguagcuuacuacaagcaccaguauacucuuuggcaacaacacaaucccuaauguaugccuuuucaagcuguugcaauguguugauaacugcguagagaucugcuaaauuaucguauuuuucccuuucccuugcauugugauacaguuuuacuucuucguaaagc

SEQ ID NO: 1019 - RNA, 351 nt, artificial sequence
  synthetic construct
guaauugugcaauauuuuauugaaagaggcauaagcacucucaagaucaaaaaguaguugucuaaucugugauucugacaauucaucugauacuugcaucguauuuaauguagccaaccauucugaaaucuuuuguuugcccucaaaauccgacggcaaaaugcucaaucuguucaugguaucgacuaaaucucucacaucaggguguaacugauccauagaacgaauaucuaaucucaauuuguccauuacaguaaugaauagggacacaauaucagcaauacaucuacuaguauuucccuuaucaucuuuaauaguaauaggucugucuuccuuaauucuuucuagggc

SEQ ID NO: 1020 - RNA, 351 nt, artificial sequence
  synthetic construct
gagggacacaauaucagcaauacaucuacuaguauuucccuuaucaucuuuaauaguaauaggucugucuuccuuaauucuuucuagggcagccgggcaaucaagccuauauuucuuaacgaaagcaucaacaguaggaaacucaucuccauuaacuugucuaaaugcugcuuuguauugaacuaguagcuuacuacaagcaccaguauacucuuuggcaacaacacaaucccuaauguaugccuuuucaagcuguugcaauguguugauaacugcguagagaucugcuaaauuaucguauuuuucccuuucccuugcauugugauacaguuuuacuucuucguaaagcuc

SEQ ID NO: 1021 - RNA, 351 nt, artificial sequence
  synthetic construct
gcucucaagaucaaaaaguaguugucuaaucugugauucugacaauucaucugauacuugcaucguauuuaauguagccaaccauucugaaaucuuuuguuugcccucaaaauccgacggcaaaaugcucaaucuguucaugguaucgacuaaaucucucacaucaggguguaacugauccauagaacgaauaucuaaucucaauuuguccauuacaguaaugaauagggacacaauaucagcaauacaucuacuaguauuucccuuaucaucuuuaauaguaauaggucugucuuccuuaauucuuucuagggcagccgggcaaucaagccuauauuucuuaacgaaagc

SEQ ID NO: 1022 - RNA, 352 nt, artificial sequence
  synthetic construct
guucaucugauacuugcaucguauuuaauguagccaaccauucugaaaucuuuuguuugcccucaaaauccgacggcaaaaugcucaaucuguucaugguaucgacuaaaucucucacaucaggguguaacugauccauagaacgaauaucuaaucucaauuuguccauuacaguaaugaauagggacacaauaucagcaauacaucuacuaguauuucccuuaucaucuuuaauaguaauaggucugucuuccuuaauucuuucuagggcagccgggcaaucaagccuauauuucuuaacgaaagcaucaacaguaggaaacucaucuccauuaacuugucuaaaugcugc

SEQ ID NO: 1023 - RNA, 351 nt, artificial sequence
  synthetic construct
guauuuaauguagccaaccauucugaaaucuuuuguuugcccucaaaauccgacggcaaaaugcucaaucuguucaugguaucgacuaaaucucucacaucaggguguaacugauccauagaacgaauaucuaaucucaauuuguccauuacaguaaugaauagggacacaauaucagcaauacaucuacuaguauuucccuuaucaucuuuaauaguaauaggucugucuuccuuaauucuuucuagggcagccgggcaaucaagccuauauuucuuaacgaaagcaucaacaguaggaaacucaucuccauuaacuugucuaaaugcugcuuuguauugaacuaguagc

SEQ ID NO: 1024 - RNA, 248 nt, artificial sequence
  synthetic construct
gaacucgauaaccaguuucucccucaauuugucaucgaugguggauacugacaauggggaggguucguuggccaggaacgugccguagucggugccuuguaaaugcagcuucaaaucuuccaggguuucgcauugcacuaaauugagguaaucggacugcuucaauaugccgcauuugaaaccgcggcauaaaccuuccaaguaaccguugucgauguuaaacagacaccccuucaugaucgaaaauc

SEQ ID NO: 1025 - RNA, 252 nt, artificial sequence
  synthetic construct
ggcccugugcuucugagccacgcacucugcgauccaaacgauguuccugcacuccugcuccuucagcuucaaauaggaauagaacacaccaaaguggaacugcugcaugaacgcguugauguucagacgcacuucgugcucgaagaauuuguccuccaacgucuuaucucccggauuguuuccagcccccucgaacaauuuggaauacucagcguaauacucggccacagccuuaaccugcucguaauccuc

SEQ ID NO: 1026 - RNA, 256 nt, artificial sequence
  synthetic construct
gaauuauguugucgaucauguagcuguaggugaugaaguccaggaauguggacagggguucuacggcuugguuacgcauaugcuggaacucgauaaccaguuucucccucaauuugucaucgaugguggauacugacaauggggaggguucguuggccaggaacgugccguagucggugccuuguaaaugcagcuucaaaucuuccaggguuucgcauugcacuaaauugagguaaucggacugcuucaauaugcc

SEQ ID NO: 1027 - RNA, 262 nt, artificial sequence
  synthetic construct
gauuucgauguucaucucguccaaauccugcucgcugaugcagucgacgaagaacggagcuagcggggugucuacuaacacggcguuguacaauuccgccgggguggccgcuacguggauggcuuccauuugcucgaagcugccgaggggguggcauuuuggaaucaacucaccgauaggucuuugaugcaaaguuccggugauuagaagaauuauguugucgaucauguagcuguaggugaugaaguccaggaauguggac

SEQ ID NO: 1028 - RNA, 252 nt, artificial sequence
  synthetic construct
gaauaucggaauguaguuaucgauuuuggcccugugcuucugagccacgcacucugcgauccaaacgauguuccugcacuccugcuccuucagcuucaaauaggaauagaacacaccaaaguggaacugcugcaugaacgcguugauguucagacgcacuucgugcucgaagaauuuguccuccaacgucuuaucucccggauuguuuccagcccccucgaacaauuuggaauacucagcguaauacucggc

SEQ ID NO: 1029 - RNA, 249 nt, artificial sequence
  synthetic construct
gaauaucggaauguaguuaucgauuuuggcccugugcuucugagccacgcacucugcgauccaaacgauguuccugcacuccugcuccuucagcuucaaauaggaauagaacacaccaaaguggaacugcugcaugaacgcguugauguucagacgcacuucgugcucgaagaauuuguccuccaacgucuuaucucccggauuguuuccagcccccucgaacaauuuggaauacucagcguaauacuc

SEQ ID NO: 1030 - RNA, 351 nt, artificial sequence
  synthetic construct
gcguccacuuccggcguuaaaugcaccgucgacucguaaaaguguuucaauuuuucaccgugcuugcuuacuaucauuaacguauugucuuuuucccaauagaugaccacggcuucguuaccgcaccauaacauuuguuucgguuugaaaacaaaaucgcaaucgauuucgcaauauuucguucucagaucugucgaacccaaccacaaaaaaccggaauccguguaaaaagccaaaugucuagcguuuaaagacaccgacauuuugauuauagauguguauuuguucguuauauccgguuccagcauugaacugguucgaucuucguccuguuucaaccuguacaauucc

SEQ ID NO: 1031 - RNA, 352 nt, artificial sequence
  synthetic construct
gauuuuccaccucgcgccuccggcagcguauccuccaauucccuuuggaaccugcacaagcgcagguguuccuccacgaugguggcguugaggucuuugcgggauuuuuuguacgccuccaaggccgacgacaaaagggcgucuuucgcgugguuuuucuuaacauccagcgagucuuugaugaaaaguucggcuugagcgcaaaaaucgucuucuugaauguaaauuucgcuuagagccugcgcguugugcucuuuacaguauuuuaugaacagcgauugagcgauagggaaauuucugauggucaucuuaaaguccccuaaaggcauguuuucucucaauuucaauaugc

SEQ ID NO: 1032 - RNA, 351 nt, artificial sequence
  synthetic construct
gagcguauccuccaauucccuuuggaaccugcacaagcgcagguguuccuccacgaugguggcguugaggucuuugcgggauuuuuuguacgccuccaaggccgacgacaaaagggcgucuuucgcgugguuuuucuuaacauccagcgagucuuugaugaaaaguucggcuugagcgcaaaaaucgucuucuugaauguaaauuucgcuuagagccugcgcguugugcucuuuacaguauuuuaugaacagcgauugagcgauagggaaauuucugauggucaucuuaaaguccccuaaaggcauguuuucucucaauuucaauaugacaguauaaacuaaauccguauc

SEQ ID NO: 1033 - RNA, 352 nt, artificial sequence
  synthetic construct
guuuucuccaucaaucgucgucgauuuucgucggaaaaucgauuucccugacauuuucccugaacguacaacaaacuuuggacgucccuuuguugauaggcuauuucggcugcuuccucuaaacgucccgcuuugauguaauauuugacuuugacauccucgccaacuuuguguaaauauuucaacgccuccugcgguuuaucgugcgccaaacaaacgucgacgaagggaugguagccgaucggggauuuuuuccauuuggagaacuucuccaauucgauccaaucguuucgaucggccaaacuggcgauuuucgcccaccaauaucuuuuaucgggaauuuugaaaucgc

SEQ ID NO: 1034 - RNA, 352 nt, artificial sequence
  synthetic construct
gucuugaauguaaauuucgcuuagagccugcgcguugugcucuuuacaguauuuuaugaacagcgauugagcgauagggaaauuucugauggucaucuuaaaguccccuaaaggcauguuuucucucaauuucaauaugacaguauaaacuaaauccguaucgccgcuuucgauggcuuugaccaaagccggcacguuuucgcccaauuccaauaguaauuucacuugaucgcucgccuucgauucguaaucuaaaagcuugauggccaacuuuuuccugccgcacuccgacgccgucgccgcuauuucgcuaaaacucaccccgccgccgcuacccuuuucgcccaauuuc

SEQ ID NO: 1035 - RNA, 352 nt, artificial sequence
  synthetic construct
gacaacaaacuuuggacgucccuuuguugauaggcuauuucggcugcuuccucuaaacgucccgcuuugauguaauauuugacuuugacauccucgccaacuuuguguaaauauuucaacgccuccugcgguuuaucgugcgccaaacaaacgucgacgaagggaugguagccgaucggggauuuuuuccauuuggagaacuucuccaauucgauccaaucguuucgaucggccaaacuggcgauuuucgcccaccaauaucuuuuaucgggaauuuugaaaucguugcgaaacuuuucggccaauuugguuucguucaauuccaauaguaauuuacacgugucuuguacgc

SEQ ID NO: 1036 - RNA, 352 nt, artificial sequence
  synthetic construct
gagucgauucugggcaacgugcagaccaaguacaaggacauaacgggcaaggaggugcaccugaagaucgacgacgagucgcacuugucgcaggagacuacgggggggaucgauuugcuggcguugaagaacaaagugaagaucaacaacacgcuggaggcgcgauuggacuugaucucgcagcaauuggugccucaaauccguaacgcucuguucgggcguaacgugaacaggaaauucaccgauuagguugcuugggguuugugcgaucguauaauauuuacaucggucgaaauaaaauaguauucgauuuauaaaauuuauuguaauguuaucaucagaugauguuguc

SEQ ID NO: 1037 - RNA, 350 nt, artificial sequence
  synthetic construct
gaauacuacgagaagaaagagaaacaagucgaacuccagaagaaaauccaaucguccaacaugcugaaccaggccagacugaagguguugaaagugagagaggaccacguucgguccgugcuggaagacgcccgcaaacgacucggcgaagucaccaaagaccaagggaaguacggccacaucaucgaaagccucauccuccaaggacucuaccagcuguucgagaaagaaguaacggugcgcgugcgcccgcaggacagggagcuggucaagucgauucugggcaacgugcagaccaaguacaaggacauaacgggcaaggaggugcaccugaagaucgacgacgaguc

SEQ ID NO: 1038 - RNA, 352 nt, artificial sequence
  synthetic construct
gaagucgauucugggcaacgugcagaccaaguacaaggacauaacgggcaaggaggugcaccugaagaucgacgacgagucgcacuugucgcaggagacuacgggggggaucgauuugcuggcguugaagaacaaagugaagaucaacaacacgcuggaggcgcgauuggacuugaucucgcagcaauuggugccucaaauccguaacgcucuguucgggcguaacgugaacaggaaauucaccgauuagguugcuugggguuugugcgaucguauaauauuuacaucggucgaaauaaaauaguauucgauuuauaaaauuuauuguaauguuaucaucagaugauguugc

SEQ ID NO: 1039 - RNA, 351 nt, artificial sequence
  synthetic construct
gagaauguugcucaucgaaucccugaucaccguccacgugaucuuguucucagauugagcggucgacucuacggcgugucucgccauaucguacaucccaaucauguucuucaacauacccacgguuuuguagaagggacagaaucugucguacgaugaguacgaguucuguugcaggaaaucuucuuucaacagcuuggcgauuuccaauguaauuuuaucagcuucggccaaugaagcuuuuccuaccagcugcacgauuucuguaagaucgucuucuucuugaagaauuuccuuaacuuugguucugagcgguaugaauuccgcaaaguuuuugucauagaaaucauc

SEQ ID NO: 1040 - RNA, 351 nt, artificial sequence
  synthetic construct
gacgugaucuuguucucagauugagcggucgacucuacggcgugucucgccauaucguacaucccaaucauguucuucaacauacccacgguuuuguagaagggacagaaucugucguacgaugaguacgaguucuguugcaggaaaucuucuuucaacagcuuggcgauuuccaauguaauuuuaucagcuucggccaaugaagcuuuuccuaccagcugcacgauuucuguaagaucgucuucuucuugaagaauuuccuuaacuuugguucugagcgguaugaauuccgcaaaguuuuugucauagaaaucaucuaaggcucucagguauuuagaguaagaacugagc

SEQ ID NO: 1041 - RNA, 351 nt, artificial sequence
  synthetic construct
gucgaaauccgccuugaucuucgccucgccgucuuucaccggauccuugaacuucauacugcucaauugguacagaauguugcucaucgaaucccugaucaccguccacgugaucuuguucucagauugagcggucgacucuacggcgugucucgccauaucguacaucccaaucauguucuucaacauacccacgguuuuguagaagggacagaaucugucguacgaugaguacgaguucuguugcaggaaaucuucuuucaacagcuuggcgauuuccaauguaauuuuaucagcuucggccaaugaagcuuuuccuaccagcugcacgauuucuguaagaucgucuuc

SEQ ID NO: 1042 - RNA, 351 nt, artificial sequence
  synthetic construct
gcgugaucuuguucucagauugagcggucgacucuacggcgugucucgccauaucguacaucccaaucauguucuucaacauacccacgguuuuguagaagggacagaaucugucguacgaugaguacgaguucuguugcaggaaaucuucuuucaacagcuuggcgauuuccaauguaauuuuaucagcuucggccaaugaagcuuuuccuaccagcugcacgauuucuguaagaucgucuucuucuugaagaauuuccuuaacuuugguucugagcgguaugaauuccgcaaaguuuuugucauagaaaucaucuaaggcucucagguauuuagaguaagaacugagcc

SEQ ID NO: 1043 - RNA, 352 nt, artificial sequence
  synthetic construct
guuuccaauguaauuuuaucagcuucggccaaugaagcuuuuccuaccagcugcacgauuucuguaagaucgucuucuucuugaagaauuuccuuaacuuugguucugagcgguaugaauuccgcaaaguuuuugucauagaaaucaucuaaggcucucagguauuuagaguaagaacugagccagucgacagacgggaaaugcuuacgcugggcgaguuucuuauccaacccccaaaacacuugcacgauaccgagaguagcagaagugacgggaucagagaaaucaccaccaggcggcgacacugcuccuacgaucgaaacagagccuucccuaucgggguuacccaagc

SEQ ID NO: 1044 - RNA, 351 nt, artificial sequence
  synthetic construct
gacggauagcgguuuuccugaucucaacacgggaucaccgacaguuacaccggaaguuucuucguagaccugaauaguugccauaucuccuuccaaacggauaauuucaccgacuaauucgaaguagcccacacguaccaauucguacauagcagauccggacaucuuuucugcugugacgacuggaccagauacagcauggacguacccauacuggcucucuuuuucuucgucuccaacacguacuuucgacauuuuuguggauguucugaaaacgagggcgauuagacgugauguuucuaauucaaccucacccacugaacuaucaaguacagcaaaucgacgauuuuc

SEQ ID NO: 1045 - RNA, 352 nt, artificial sequence
  synthetic construct
guaauuuuaucagcuucggccaaugaagcuuuuccuaccagcugcacgauuucuguaagaucgucuucuucuugaagaauuuccuuaacuuugguucugagcgguaugaauuccgcaaaguuuuugucauagaaaucaucuaaggcucucagguauuuagaguaagaacugagccagucgacagacgggaaaugcuuacgcugggcgaguuucuuauccaacccccaaaacacuugcacgauaccgagaguagcagaagugacgggaucagagaaaucaccaccaggcggcgacacugcuccuacgaucgaaacagagccuucccuaucgggguuacccaagcacuuaacgc

SEQ ID NO: 1046 - RNA, 351 nt, artificial sequence
  synthetic construct
gcaaucacuuaacaagucgucaucuauauugauauccguuguaucuauauuuucaucaauguucacuccaucaagauccaaauccaaaucguccucaucagcuucuucauuaucaacagaggguuuguucguuuguucaaccgguguuucgccgagcaaauuaucgaaauaacuugcaccugaauuuuugacuuucgcuugaaccuccgcuaucauauuucugucgugauucgguguaacggugacagccgaagcggcaggaaugaaacccgguucguuuuguuccaaauauuucugcgccgcuauggccucuugcagcccuggaaacagauuuucguaauccuugggauc

SEQ ID NO: 1047 - RNA, 350 nt, artificial sequence
  synthetic construct
ggccgugacguucuguccgugccccucuaacguuuguacgcacguuuuguucugguaaucccagauuuuaaccagccugucgucggcgcccgauauuagguaggguuuaucgccaccgugauaguaaucgacgcaauuaacgcccuuuucgugacccuccaacgugaaauuagcaguagaggcgccuaacugccaaacuuuuauuguucgguccaaagaagcgcuggcgaacguauuguugucuuugggguugauggaaauuugcaugauguaaugcacgugcccuucgaacacuuguuggcacgcccacgcuuuuucccaguuccacagcuuuaucagcauaucaucgc

SEQ ID NO: 1048 - RNA, 351 nt, artificial sequence
  synthetic construct
gaauguauuccccgucuccacaaacgaccacaaaucuaccauucggauugugcugaauaguuugcggguagauaucacaagcgcccauaucuuugauagaaaccggcaagcguucaccgucucuuauuucagcaccuucgggcaacgcuuuaagauuagcuugcuguaguuccgaaugucuggcccagaugauuuuaccgccgcuggcguccauacucacagcggguucuucucuaccgacuuuaaccagaaugcuacccucgucguaacccagcgccacguuauuggaaccuuucagacaaaaaaugguccauacucuuucgaaaccguaguucaaacugcucucuaauc

SEQ ID NO: 1049 - RNA, 351 nt, artificial sequence
  synthetic construct
guaaucgacgcaauuaacgcccuuuucgugacccuccaacgugaaauuagcaguagaggcgccuaacugccaaacuuuuauuguucgguccaaagaagcgcuggcgaacguauuguugucuuugggguugauggaaauuugcaugauguaaugcacgugcccuucgaacacuuguuggcacgcccacgcuuuuucccaguuccacagcuuuaucagcauaucaucgcuacuggucaguauguaagguugugugggaugaacaacaauggaucgcacguaaucagagugagcuucgaaagcgugcacgcgaucuagaguguuguaauugaaaacucugauuugcaugucauc

SEQ ID NO: 1050 - RNA, 351 nt, artificial sequence
  synthetic construct
guggaaccggauucucugauggcguauucgcuggaauccugcgcccaaacgaauucuugcgcgcuuccgaaagcuuuauuucugagcgccauggcgguguaaauaauguauuccccgucuccacaaacgaccacaaaucuaccauucggauugugcugaauaguuugcggguagauaucacaagcgcccauaucuuugauagaaaccggcaagcguucaccgucucuuauuucagcaccuucgggcaacgcuuuaagauuagcuugcuguaguuccgaaugucuggcccagaugauuuuaccgccgcuggcguccauacucacagcggguucuucucuaccgacuuuaacc

SEQ ID NO: 1051 - RNA, 351 nt, artificial sequence
  synthetic construct
guauaaaauaacuaucuucgguggcuaaacacaccaauuugccgcuguccgaccaguagaucgaacggggcuguauuucgauucuucugaccaaauccaacguuucccagucguagaaagccaaucccgagacggauuuuacccccaaaagauaaccgccguauauaccuucggcuccgaagucggauuugaaauucuuuuuuucuuugaaauuuuugaauauucuuauaguggaaccggauucucugauggcguauucgcuggaauccugcgcccaaacgaauucuugcgcgcuuccgaaagcuuuauuucugagcgccauggcgguguaaauaauguauuccccgucuc

SEQ ID NO: 1052 - RNA, 351 nt, artificial sequence
  synthetic construct
gauuuuaucgggaagauaagaucucgcgaaaaacgccgcuucgggaagccuaccggugcuuaucaaaauguccagacauuuguucaagucaccgacuaauaagugggacaagaaugccaaguuaugcuugcccucggcuuccguggcuucgccuaauguccucacuaccucgucaucuccagaacugguagcuaagagcaacaauccaccguaaucuugggcuuucugcaugcacucuuuggccaacacgagauuauucguggaggccgccaaaucggccaguuggcuccauuucugcggguuguuagccuccugggccaacauuuuggccguauucaaauccuccaaagc

SEQ ID NO: 1053 - RNA, 352 nt, artificial sequence
  synthetic construct
gugacagccgaagcggcaggaaugaaacccgguucguuuuguuccaaauauuucugcgccgcuauggccucuugcagcccuggaaacagauuuucguaauccuugggaucggccaaacuuuggccggcuuucugauugacagucgacaauugggcccuccaaagguccaccaccuccgaaauuuuaucgggaagauaagaucucgcgaaaaacgccgcuucgggaagccuaccggugcuuaucaaaauguccagacauuuguucaagucaccgacuaauaagugggacaagaaugccaaguuaugcuugcccucggcuuccguggcuucgccuaauguccucacuaccucgc

SEQ ID NO: 1054 - RNA, 350 nt, artificial sequence
  synthetic construct
ggaaaguggaaagagaagccaagauggauccaccgauccauacggaguauuuccuuucugggggagcgaugaucuugauuuugaucgugcugggggccaaggcggugauuuccuuuugcauacggucagcaauaccaggguacauggugguaccaccggacaagacgguguuggcguacaaguccuuacggauaucgacgucacacuucaugauggaguuguagacgguuucguggauaccgcaggauuccauacccaagaaggaagguuggaauagagccucaggacaacggaaucucucguuaccgauggugaugacuugaccgucggguaauucguagcucuuuucc

SEQ ID NO: 1055 - RNA, 352 nt, artificial sequence
  synthetic construct
guggcuuuaggguuaagaggagcuucggucaaaagaacgggguguucuuccggagccacacggaguucguuguagaagguguggugccagaucuuuuccauaucaucccaguuggugaugauaccguguucgaugggguauuucaaagugaggauaccucuuuugcuuugggcuucgucaccuacguaggaaucuuuuugacccauaccgaccaugacuccuugaugucuugggcgaccgacgauggagggaaagacggcgcgcggagcgucgucuccggcgaaaccggccuugcacauaccggagccauugucuacgacuaaagcggcgacuucuucuucacacauuuugc

SEQ ID NO: 1056 - RNA, 351 nt, artificial sequence
  synthetic construct
ggaaagagaagccaagauggauccaccgauccauacggaguauuuccuuucugggggagcgaugaucuugauuuugaucgugcugggggccaaggcggugauuuccuuuugcauacggucagcaauaccaggguacauggugguaccaccggacaagacgguguuggcguacaaguccuuacggauaucgacgucacacuucaugauggaguuguagacgguuucguggauaccgcaggauuccauacccaagaaggaagguuggaauagagccucaggacaacggaaucucucguuaccgauggugaugacuugaccgucggguaauucguagcucuuuuccaaugaggc

SEQ ID NO: 1057 - RNA, 352 nt, artificial sequence
  synthetic construct
guuacggauaucgacgucacacuucaugauggaguuguagacgguuucguggauaccgcaggauuccauacccaagaaggaagguuggaauagagccucaggacaacggaaucucucguuaccgauggugaugacuugaccgucggguaauucguagcucuuuuccaaugagguggaagcggcggcgguggccauuuccuguucgaaguccaaugcgacauagcagaguuuuuccuugaugucacggacgauuucucuuucagcggugguggugaaugaguaaccucuuucggugaggauuuucaugagguagucggucaaaucgcgaccggccaaguccaaacggaggauc

SEQ ID NO: 1058 - RNA, 352 nt, artificial sequence
  synthetic construct
guucaaacaugauuugagucaucuuuucccuguuggcuuuaggguuaagaggagcuucggucaaaagaacgggguguucuuccggagccacacggaguucguuguagaagguguggugccagaucuuuuccauaucaucccaguuggugaugauaccguguucgaugggguauuucaaagugaggauaccucuuuugcuuugggcuucgucaccuacguaggaaucuuuuugacccauaccgaccaugacuccuugaugucuugggcgaccgacgauggagggaaagacggcgcgcggagcgucgucuccggcgaaaccggccuugcacauaccggagccauugucuacgac

SEQ ID NO: 1059 - RNA, 352 nt, artificial sequence
  synthetic construct
guuucaaacaugauuugagucaucuuuucccuguuggcuuuaggguuaagaggagcuucggucaaaagaacgggguguucuuccggagccacacggaguucguuguagaagguguggugccagaucuuuuccauaucaucccaguuggugaugauaccguguucgaugggguauuucaaagugaggauaccucuuuugcuuugggcuucgucaccuacguaggaaucuuuuugacccauaccgaccaugacuccuugaugucuugggcgaccgacgauggagggaaagacggcgcgcggagcgucgucuccggcgaaaccggccuugcacauaccggagccauugucuacgc

SEQ ID NO: 1060 - RNA, 351 nt, artificial sequence
  synthetic construct
guagaagcacuugcggugaacgauuccagggccggauucgucguauuccuguuuggagauccacaucuguuggaaaguggaaagagaagccaagauggauccaccgauccauacggaguauuuccuuucugggggagcgaugaucuugauuuugaucgugcugggggccaaggcggugauuuccuuuugcauacggucagcaauaccaggguacauggugguaccaccggacaagacgguguuggcguacaaguccuuacggauaucgacgucacacuucaugauggaguuguagacgguuucguggauaccgcaggauuccauacccaagaaggaagguuggaauagagc

SEQ ID NO: 1061 - RNA, 352 nt, artificial sequence
  synthetic construct
gugauuugagucaucuuuucccuguuggcuuuaggguuaagaggagcuucggucaaaagaacgggguguucuuccggagccacacggaguucguuguagaagguguggugccagaucuuuuccauaucaucccaguuggugaugauaccguguucgaugggguauuucaaagugaggauaccucuuuugcuuugggcuucgucaccuacguaggaaucuuuuugacccauaccgaccaugacuccuugaugucuugggcgaccgacgauggagggaaagacggcgcgcggagcgucgucuccggcgaaaccggccuugcacauaccggagccauugucuacgacuaaagcgc

SEQ ID NO: 1062 - RNA, 350 nt, artificial sequence
  synthetic construct
gggugacaccgucaccggaguccaaaacgauaccggugguacgaccggaagcguacaaggaaaguacggcuuggauggcgacguacauagcggggguguugaagguuucaaacaugauuugagucaucuuuucccuguuggcuuuaggguuaagaggagcuucggucaaaagaacgggguguucuuccggagccacacggaguucguuguagaagguguggugccagaucuuuuccauaucaucccaguuggugaugauaccguguucgaugggguauuucaaagugaggauaccucuuuugcuuugggcuucgucaccuacguaggaaucuuuuugacccauaccgacc

SEQ ID NO: 1063 - RNA, 350 nt, artificial sequence
  synthetic construct
gcgugaggcaaagcguaaccuucguagauggguacggugugggugacaccgucaccggaguccaaaacgauaccggugguacgaccggaagcguacaaggaaaguacggcuuggauggcgacguacauagcggggguguugaagguuucaaacaugauuugagucaucuuuucccuguuggcuuuaggguuaagaggagcuucggucaaaagaacgggguguucuuccggagccacacggaguucguuguagaagguguggugccagaucuuuuccauaucaucccaguuggugaugauaccguguucgaugggguauuucaaagugaggauaccucuuuugcuuugggc

SEQ ID NO: 1064 - RNA, 351 nt, artificial sequence
  synthetic construct
guucuggagggccucagcggcguuccucauggagucuaagacggcuguguuggugcuggcuccuuccaaggccucucuuugcauuucgaucgucguaagaguuccaucuauuuguaguugcguuuuuuccaaucguuucuucuuuuugagcgcuugaagcgccacucuuuuguucuucgaugcauucuuuuuggcuacuaaaguguauuccucuauuuucuuuucuaaaaacucuuguuuuuuauauaacauguccucgguuucccugagcuuuuggauggccuccccgggcguagggcccucgucuuuuuccuuuccuccgaauauuuuacuaaagaaacucauuuuucc

SEQ ID NO: 1065 - RNA, 352 nt, artificial sequence
  synthetic construct
guaaucucauuggcaauaucguguuguucagcuaugucguccaugauaucguggacaucaucgacguucaaguuuuugugggccuucuggagggccucagcggcguuccucauggagucuaagacggcuguguuggugcuggcuccuuccaaggccucucuuugcauuucgaucgucguaagaguuccaucuauuuguaguugcguuuuuuccaaucguuucuucuuuuugagcgcuugaagcgccacucuuuuguucuucgaugcauucuuuuuggcuacuaaaguguauuccucuauuuucuuuucuaaaaacucuuguuuuuuauauaacauguccucgguuucccugc

SEQ ID NO: 1066 - RNA, 351 nt, artificial sequence
  synthetic construct
gcguuccucauggagucuaagacggcuguguuggugcuggcuccuuccaaggccucucuuugcauuucgaucgucguaagaguuccaucuauuuguaguugcguuuuuuccaaucguuucuucuuuuugagcgcuugaagcgccacucuuuuguucuucgaugcauucuuuuuggcuacuaaaguguauuccucuauuuucuuuucuaaaaacucuuguuuuuuauauaacauguccucgguuucccugagcuuuuggauggccuccccgggcguagggcccucgucuuuuuccuuuccuccgaauauuuuacuaaagaaacucauuuuuccaauggaaauaagggaaaac

SEQ ID NO: 1067 - RNA, 352 nt, artificial sequence
  synthetic construct
guuucaguaaaucuuccucuaauccuucuuguuccaguuucuccaguucgcuuuccaauucguccucguccaaaucgucggcgaagcccacagguugacuaauagcaguuguaaucucauuggcaauaucguguuguucagcuaugucguccaugauaucguggacaucaucgacguucaaguuuuugugggccuucuggagggccucagcggcguuccucauggagucuaagacggcuguguuggugcuggcuccuuccaaggccucucuuugcauuucgaucgucguaagaguuccaucuauuuguaguugcguuuuuuccaaucguuucuucuuuuugagcgcuugaac

SEQ ID NO: 1068 - RNA, 351 nt, artificial sequence
  synthetic construct
guaauagcaguuguaaucucauuggcaauaucguguuguucagcuaugucguccaugauaucguggacaucaucgacguucaaguuuuugugggccuucuggagggccucagcggcguuccucauggagucuaagacggcuguguuggugcuggcuccuuccaaggccucucuuugcauuucgaucgucguaagaguuccaucuauuuguaguugcguuuuuuccaaucguuucuucuuuuugagcgcuugaagcgccacucuuuuguucuucgaugcauucuuuuuggcuacuaaaguguauuccucuauuuucuuuucuaaaaacucuuguuuuuuauauaacaugucc

SEQ ID NO: 1069 - RNA, 352 nt, artificial sequence
  synthetic construct
guaaaucuuccucuaauccuucuuguuccaguuucuccaguucgcuuuccaauucguccucguccaaaucgucggcgaagcccacagguugacuaauagcaguuguaaucucauuggcaauaucguguuguucagcuaugucguccaugauaucguggacaucaucgacguucaaguuuuugugggccuucuggagggccucagcggcguuccucauggagucuaagacggcuguguuggugcuggcuccuuccaaggccucucuuugcauuucgaucgucguaagaguuccaucuauuuguaguugcguuuuuuccaaucguuucuucuuuuugagcgcuugaagcgccac

SEQ ID NO: 1070 - RNA, 352 nt, artificial sequence
  synthetic construct
gagcaguuguaaucucauuggcaauaucguguuguucagcuaugucguccaugauaucguggacaucaucgacguucaaguuuuugugggccuucuggagggccucagcggcguuccucauggagucuaagacggcuguguuggugcuggcuccuuccaaggccucucuuugcauuucgaucgucguaagaguuccaucuauuuguaguugcguuuuuuccaaucguuucuucuuuuugagcgcuugaagcgccacucuuuuguucuucgaugcauucuuuuuggcuacuaaaguguauuccucuauuuucuuuucuaaaaacucuuguuuuuuauauaacauguccucggc

SEQ ID NO: 1071 - RNA, 351 nt, artificial sequence
  synthetic construct
guacgaagcccaagccuccaauuccuucaugucaucaucauccuccacuuuuuuagcagcagguuuaaccgguuuagcgauagcccccguagguacagcggguaauucaguaggacccggaacuuucaguaaaucuuccucuaauccuucuuguuccaguuucuccaguucgcuuuccaauucguccucguccaaaucgucggcgaagcccacagguugacuaauagcaguuguaaucucauuggcaauaucguguuguucagcuaugucguccaugauaucguggacaucaucgacguucaaguuuuugugggccuucuggagggccucagcggcguuccucauggaguc

SEQ ID NO: 1072 - RNA, 351 nt, artificial sequence
  synthetic construct
gcguauccuccaauucccuuuggaaccugcacaagcgcagguguuccuccacgaugguggcguugaggucuuugcgggauuuuuuguacgccuccaaggccgacgacaaaagggcgucuuucgcgugguuuuucuuaacauccagcgagucuuugaugaaaaguucggcuugagcgcaaaaaucgucuucuugaauguaaauuucgcuuagagccugcgcguugugcucuuuacaguauuuuaugaacagcgauugagcgauagggaaauuucugauggucaucuuaaaguccccuaaaggcauguuuucucucaauuucaauaugacaguauaaacuaaauccguaucgc

SEQ ID NO: 1073 - RNA, 351 nt, artificial sequence
  synthetic construct
gaaaguucggcuugagcgcaaaaaucgucuucuugaauguaaauuucgcuuagagccugcgcguugugcucuuuacaguauuuuaugaacagcgauugagcgauagggaaauuucugauggucaucuuaaaguccccuaaaggcauguuuucucucaauuucaauaugacaguauaaacuaaauccguaucgccgcuuucgauggcuuugaccaaagccggcacguuuucgcccaauuccaauaguaauuucacuugaucgcucgccuucgauucguaaucuaaaagcuugauggccaacuuuuuccugccgcacuccgacgccgucgccgcuauuucgcuaaaacucacc

SEQ ID NO: 1074 - RNA, 351 nt, artificial sequence
  synthetic construct
guuaugaacagcgauugagcgauagggaaauuucugauggucaucuuaaaguccccuaaaggcauguuuucucucaauuucaauaugacaguauaaacuaaauccguaucgccgcuuucgauggcuuugaccaaagccggcacguuuucgcccaauuccaauaguaauuucacuugaucgcucgccuucgauucguaaucuaaaagcuugauggccaacuuuuuccugccgcacuccgacgccgucgccgcuauuucgcuaaaacucaccccgccgccgcuacccuuuucgcccaauuuggcggcuaucucucuggcgaccgucuccucgucgagucgacuuugaccgacc

SEQ ID NO: 1075 - RNA, 352 nt, artificial sequence
  synthetic construct
guugcuuacuaucauuaacguauugucuuuuucccaauagaugaccacggcuucguuaccgcaccauaacauuuguuucgguuugaaaacaaaaucgcaaucgauuucgcaauauuucguucucagaucugucgaacccaaccacaaaaaaccggaauccguguaaaaagccaaaugucuagcguuuaaagacaccgacauuuugauuauagauguguauuuguucguuauauccgguuccagcauugaacugguucgaucuucguccuguuucaaccuguacaauuccaagcuucuagccaccaaaaucuccguccuauugucaucagaaacaaucgcccaaccaguaggc

SEQ ID NO: 1076 - RNA, 352 nt, artificial sequence
  synthetic construct
gcaacaaacuuuggacgucccuuuguugauaggcuauuucggcugcuuccucuaaacgucccgcuuugauguaauauuugacuuugacauccucgccaacuuuguguaaauauuucaacgccuccugcgguuuaucgugcgccaaacaaacgucgacgaagggaugguagccgaucggggauuuuuuccauuuggagaacuucuccaauucgauccaaucguuucgaucggccaaacuggcgauuuucgcccaccaauaucuuuuaucgggaauuuugaaaucguugcgaaacuuuucggccaauuugguuucguucaauuccaauaguaauuuacacgugucuuguacggc

SEQ ID NO: 1077 - RNA, 352 nt, artificial sequence
  synthetic construct
gaaggcgaugcguuguuguguauagaagucgaugcauuuugcaagagugguuucaacauauucuguucuagcauuuacgucgaagagaucaccagcucccaaagcguacguuaacgagucuucgaacgcacccagaugguaguauacuuuacuagcgacuaaagcagcuaacugguguuguugaaacacuuugucuucgugcagaauuucuaucuuuucaauagcuucugaaauuucuggccagaauucgucgacuauggagucuaguuuucuuaacgcgaauacuuuaaguucuggucuugguucuucuaaaagggauauaauccccgcagccgaaguaauauucauccuc

SEQ ID NO: 1078 - RNA, 351 nt, artificial sequence
  synthetic construct
guaauaauuuucuaaucgccugguugugucccgugccgcaauaagccauagcuaauguauacaugccggaucuucucaggauuggauccuuaucagaaguaagcuguuguauuaggguaucagcuucuucuaaucggccguacaucgugaagcuuauaccaacagccaaaccgcgaagaaucuuuucguguugacucucuugcgcguacgcuaccauauccauaaucguaguggaauuacuggauccuaacauaaccaugcccaucgcaauuccagcggccucuccgguauuagcaucaucuugauagagauugaacuucagcuguucguagacaucuugccugugugucc

SEQ ID NO: 1079 - RNA, 351 nt, artificial sequence
  synthetic construct
gcauucgaaugguucuggugguucugguuccuuuucaucaucgcccuuuggaccgaaugcugcuacggguuccaccaauuccucuucaccagguuucaaauugcgaaccauaauaaucccuccgaucgaaacauccuucauugcaacguauugcgaguuaucauuaagcguaaucacuuucagcuguugccucaugguccuggcaggauuuugcaggauuucgaaacuaggcucgggcuccuuuuucuucuccuccuuaucaucuuucuuaucuuuuuugucgucgcucgacgacgccgcuuuuuuaucgucgguuuucuuaucaucggacuuuuucuccucuuucuucuc

SEQ ID NO: 1080 - RNA, 351 nt, artificial sequence
  synthetic construct
gcugcuacggguuccaccaauuccucuucaccagguuucaaauugcgaaccauaauaaucccuccgaucgaaacauccuucauugcaacguauugcgaguuaucauuaagcguaaucacuuucagcuguugccucaugguccuggcaggauuuugcaggauuucgaaacuaggcucgggcuccuuuuucuucuccuccuuaucaucuuucuuaucuuuuuugucgucgcucgacgacgccgcuuuuuuaucgucgguuuucuuaucaucggacuuuuucuccucuuucuucucuucgguuuucuucuccuucuccuccuucucgggcuucuuaucgucuuuaucuucgucc

SEQ ID NO: 1081 - RNA, 352 nt, artificial sequence
  synthetic construct
gauucgaaugguucuggugguucugguuccuuuucaucaucgcccuuuggaccgaaugcugcuacggguuccaccaauuccucuucaccagguuucaaauugcgaaccauaauaaucccuccgaucgaaacauccuucauugcaacguauugcgaguuaucauuaagcguaaucacuuucagcuguugccucaugguccuggcaggauuuugcaggauuucgaaacuaggcucgggcuccuuuuucuucuccuccuuaucaucuuucuuaucuuuuuugucgucgcucgacgacgccgcuuuuuuaucgucgguuuucuuaucaucggacuuuuucuccucuuucuucucuc

SEQ ID NO: 1082 - RNA, 352 nt, artificial sequence
  synthetic construct
gugcugcuacggguuccaccaauuccucuucaccagguuucaaauugcgaaccauaauaaucccuccgaucgaaacauccuucauugcaacguauugcgaguuaucauuaagcguaaucacuuucagcuguugccucaugguccuggcaggauuuugcaggauuucgaaacuaggcucgggcuccuuuuucuucuccuccuuaucaucuuucuuaucuuuuuugucgucgcucgacgacgccgcuuuuuuaucgucgguuuucuuaucaucggacuuuuucuccucuuucuucucuucgguuuucuucuccuucuccuccuucucgggcuucuuaucgucuuuaucuucguc

SEQ ID NO: 1083 - RNA, 352 nt, artificial sequence
  synthetic construct
guuaacgcguacauaccagccucggugcaaacacccuucacuucggcaccgcuagcgcccggcaucaauucggcgauuuuccucagauugauuccucuggucaaauucauuuuucuagagugaauuuucaggauguccaaucgggcuuccucguucgguggcgggaauucgauuuuccugucgauucugccgggucugagcaaagccgggucuaaaauaucgauucuguugguggccaugaugacuuuaauguuuuucgucgcuucgaauccguccaauugauugagcaacuccaacauuguucucuggacuucggaaucaccgcccgaaccugauucgauacgagaagauc

SEQ ID NO: 1084 - RNA, 352 nt, artificial sequence
  synthetic construct
guaacgaaaaguucucuaaccauccuggaaccuucuccgaugaauuuuugcaccaacuccgauccagauacacgaauaaacguacauucuguaugaugagccacugcucuggccaaaagaguuuuuccaguuccuggaggaccguauaaaagcacacccuucgguugagcgauacccaaggcaucgaaaaguucaggaugcuucacgggcaauucaaugaccucuuugauuucuuuuauuugcuuguccagaccaccgaccauuucguaaguggaauccggcacuuuuuccaccaucauaagagacacuaaaggauccaccuuauucgguaaaauuuugugcaaaguguaac

SEQ ID NO: 1085 - RNA, 352 nt, artificial sequence
  synthetic construct
gagagcaacucuacaauugggugugacaucguuaaugucgauauucuuaucgauaucgaccacaaauuuucccuccggaugaacuuugacgaggacuuucuucuuguccaucgguuuuacuacuucaccuacguagcuuccuuguucuugaagcaacaucaguucuucucuaagcauacgaacuuuggcguuaaguucguuccuuugggccugcaaucuucgaagguuuugacucuuuucggcaacgauaaguugcaauucuucgauuuucguaauguaauacgaccugaagccuucccccuucaggccuccgucgaccuccaucuuauugauaacagucaucgucgguuuc

SEQ ID NO: 1086 - RNA, 351 nt, artificial sequence
  synthetic construct
gaagagacacuaaaggauccaccuuauucgguaaaauuuugugcaaaguguaagauucauuucgaagagcaacucuacaauugggugugacaucguuaaugucgauauucuuaucgauaucgaccacaaauuuucccuccggaugaacuuugacgaggacuuucuucuuguccaucgguuuuacuacuucaccuacguagcuuccuuguucuugaagcaacaucaguucuucucuaagcauacgaacuuuggcguuaaguucguuccuuugggccugcaaucuucgaagguuuugacucuuuucggcaacgauaaguugcaauucuucgauuuucguaauguaauacgacc

SEQ ID NO: 1087 - RNA, 351 nt, artificial sequence
  synthetic construct
gucucucucuuaacgcguacauaccagccucggugcaaacacccuucacuucggcaccgcuagcgcccggcaucaauucggcgauuuuccucagauugauuccucuggucaaauucauuuuucuagagugaauuuucaggauguccaaucgggcuuccucguucgguggcgggaauucgauuuuccugucgauucugccgggucugagcaaagccgggucuaaaauaucgauucuguugguggccaugaugacuuuaauguuuuucgucgcuucgaauccguccaauugauugagcaacuccaacauuguucucuggacuucggaaucaccgcccgaaccugauucgauac

SEQ ID NO: 1088 - RNA, 352 nt, artificial sequence
  synthetic construct
gucgaagagcaacucuacaauugggugugacaucguuaaugucgauauucuuaucgauaucgaccacaaauuuucccuccggaugaacuuugacgaggacuuucuucuuguccaucgguuuuacuacuucaccuacguagcuuccuuguucuugaagcaacaucaguucuucucuaagcauacgaacuuuggcguuaaguucguuccuuugggccugcaaucuucgaagguuuugacucuuuucggcaacgauaaguugcaauucuucgauuuucguaauguaauacgaccugaagccuucccccuucaggccuccgucgaccuccaucuuauugauaacagucaucgucgc

SEQ ID NO: 1089 - RNA, 352 nt, artificial sequence
  synthetic construct
guugagcaacuccaacauuguucucuggacuucggaaucaccgcccgaaccugauucgauacgagaagauccaauagaaucgauuucguccaugaaaauuauggaaggugcguguucucuggccauaacgaaaaguucucuaaccauccuggaaccuucuccgaugaauuuuugcaccaacuccgauccagauacacgaauaaacguacauucuguaugaugagccacugcucuggccaaaagaguuuuuccaguuccuggaggaccguauaaaagcacacccuucgguugagcgauacccaaggcaucgaaaaguucaggaugcuucacgggcaauucaaugaccucuuuc

SEQ ID NO: 1090 - RNA, 351 nt, artificial sequence
  synthetic construct
gucauaagagacacuaaaggauccaccuuauucgguaaaauuuugugcaaaguguaagauucauuucgaagagcaacucuacaauugggugugacaucguuaaugucgauauucuuaucgauaucgaccacaaauuuucccuccggaugaacuuugacgaggacuuucuucuuguccaucgguuuuacuacuucaccuacguagcuuccuuguucuugaagcaacaucaguucuucucuaagcauacgaacuuuggcguuaaguucguuccuuugggccugcaaucuucgaagguuuugacucuuuucggcaacgauaaguugcaauucuucgauuuucguaauguaauac

SEQ ID NO: 1091 - RNA, 351 nt, artificial sequence
  synthetic construct
guaagagacacuaaaggauccaccuuauucgguaaaauuuugugcaaaguguaagauucauuucgaagagcaacucuacaauugggugugacaucguuaaugucgauauucuuaucgauaucgaccacaaauuuucccuccggaugaacuuugacgaggacuuucuucuuguccaucgguuuuacuacuucaccuacguagcuuccuuguucuugaagcaacaucaguucuucucuaagcauacgaacuuuggcguuaaguucguuccuuugggccugcaaucuucgaagguuuugacucuuuucggcaacgauaaguugcaauucuucgauuuucguaauguaauacgac

SEQ ID NO: 1092 - RNA, 352 nt, artificial sequence
  synthetic construct
gauuucgaagagcaacucuacaauugggugugacaucguuaaugucgauauucuuaucgauaucgaccacaaauuuucccuccggaugaacuuugacgaggacuuucuucuuguccaucgguuuuacuacuucaccuacguagcuuccuuguucuugaagcaacaucaguucuucucuaagcauacgaacuuuggcguuaaguucguuccuuugggccugcaaucuucgaagguuuugacucuuuucggcaacgauaaguugcaauucuucgauuuucguaauguaauacgaccugaagccuucccccuucaggccuccgucgaccuccaucuuauugauaacagucaucgc

SEQ ID NO: 1093 - RNA, 350 nt, artificial sequence
  synthetic construct
gcgcuauagucucuccguggaauaucaaaauuuggaaaaacguguccauaagcaguauucuaucgggcuguauggaacucguaucuaauagaacaggcuccggagggccguugaaacuguaacuguacaaaauugguugaaucaugaucaaugauugaguaagaucuucucucaucagcauaugucgauagaacgacguuucaucaggagaauuauugaaaacuugcaggaacugagaccuccuuagaugguacaugaauugcggauagaggcuaaaguuuuggcccaaucugaaugaaccagcaucgucuuuauuguauucuccgaauuuuugacacaaucgaaucagc

SEQ ID NO: 1094 - RNA, 351 nt, artificial sequence
  synthetic construct
guuuguaauaucucuugagcaucguccacgggcgcuugcaaaaguugccuaaaguuuucguauucgggcauauccugguacuucaaauuucgccauugcgcuauagucucuccguggaauaucaaaauuuggaaaaacguguccauaagcaguauucuaucgggcuguauggaacucguaucuaauagaacaggcuccggagggccguugaaacuguaacuguacaaaauugguugaaucaugaucaaugauugaguaagaucuucucucaucagcauaugucgauagaacgacguuucaucaggagaauuauugaaaacuugcaggaacugagaccuccuuagaugguac

SEQ ID NO: 1095 - RNA, 352 nt, artificial sequence
  synthetic construct
gaucagcauaugucgauagaacgacguuucaucaggagaauuauugaaaacuugcaggaacugagaccuccuuagaugguacaugaauugcggauagaggcuaaaguuuuggcccaaucugaaugaaccagcaucgucuuuauuguauucuccgaauuuuugacacaaucgaaucagcauucuaucgacccaucucagaacgucgggacuuucaucugauucagcucuauaaacagccauucuggccauaauuacagcugcugcuucuugaucaaaaccagcgcugaugugguggauauuaguaguggcgucagcccaguuucgagccacuguugucacucuaauucuucuc

SEQ ID NO: 1096 - RNA, 352 nt, artificial sequence
  synthetic construct
guacaucgucuguuaaaaccggagcgccagcguccccuccauaugaauacauguuauugugagucugacucggauugacuuuggacaauaaaaaucuagccugcgauccuccuuguucgguaucgauauaucucggcaugggaaaucucguuuguaauaucucuugagcaucguccacgggcgcuugcaaaaguugccuaaaguuuucguauucgggcauauccugguacuucaaauuucgccauugcgcuauagucucuccguggaauaucaaaauuuggaaaaacguguccauaagcaguauucuaucgggcuguauggaacucguaucuaauagaacaggcuccggagc

SEQ ID NO: 1097 - RNA, 352 nt, artificial sequence
  synthetic construct
guuaaugauacacaggauccaaugccuccuugcacuuuuaauucucgagaacauuucacuucuaauguuccguuaaaagccauuuucaaaucguuuuucugaucucugguaaacacucuuuggaacguuuguuugaacaacgaggaauugaacgagucucccaucaccauaugaccuccuguagaauugacgcauugcuucauuuccaucaaaccaguuugaucaagagcgcaggaauagaugucaauacaaugaccguuagucgccgcucucauagccagaguaucguaauguuuaauagcuuuuuucauguauuucgcguuaucuuuuuggaugucaugaugggaucuac

SEQ ID NO: 1098 - RNA, 351 nt, artificial sequence
  synthetic construct
gcuaucgggcuguauggaacucguaucuaauagaacaggcuccggagggccguugaaacuguaacuguacaaaauugguugaaucaugaucaaugauugaguaagaucuucucucaucagcauaugucgauagaacgacguuucaucaggagaauuauugaaaacuugcaggaacugagaccuccuuagaugguacaugaauugcggauagaggcuaaaguuuuggcccaaucugaaugaaccagcaucgucuuuauuguauucuccgaauuuuugacacaaucgaaucagcauucuaucgacccaucucagaacgucgggacuuucaucugauucagcucuauaaacagc

SEQ ID NO: 1099 - RNA, 352 nt, artificial sequence
  synthetic construct
guuuaaugauacacaggauccaaugccuccuugcacuuuuaauucucgagaacauuucacuucuaauguuccguuaaaagccauuuucaaaucguuuuucugaucucugguaaacacucuuuggaacguuuguuugaacaacgaggaauugaacgagucucccaucaccauaugaccuccuguagaauugacgcauugcuucauuuccaucaaaccaguuugaucaagagcgcaggaauagaugucaauacaaugaccguuagucgccgcucucauagccagaguaucguaauguuuaauagcuuuuuucauguauuucgcguuaucuuuuuggaugucaugaugggaucuc

SEQ ID NO: 1100 - RNA, 352 nt, artificial sequence
  synthetic construct
guaucucuugagcaucguccacgggcgcuugcaaaaguugccuaaaguuuucguauucgggcauauccugguacuucaaauuucgccauugcgcuauagucucuccguggaauaucaaaauuuggaaaaacguguccauaagcaguauucuaucgggcuguauggaacucguaucuaauagaacaggcuccggagggccguugaaacuguaacuguacaaaauugguugaaucaugaucaaugauugaguaagaucuucucucaucagcauaugucgauagaacgacguuucaucaggagaauuauugaaaacuugcaggaacugagaccuccuuagaugguacaugaauuc

SEQ ID NO: 1101 - RNA, 352 nt, artificial sequence
  synthetic construct
gugcgcuauagucucuccguggaauaucaaaauuuggaaaaacguguccauaagcaguauucuaucgggcuguauggaacucguaucuaauagaacaggcuccggagggccguugaaacuguaacuguacaaaauugguugaaucaugaucaaugauugaguaagaucuucucucaucagcauaugucgauagaacgacguuucaucaggagaauuauugaaaacuugcaggaacugagaccuccuuagaugguacaugaauugcggauagaggcuaaaguuuuggcccaaucugaaugaaccagcaucgucuuuauuguauucuccgaauuuuugacacaaucgaaucagc

SEQ ID NO: 1102 - RNA, 351 nt, artificial sequence
  synthetic construct
gauugcgcuauagucucuccguggaauaucaaaauuuggaaaaacguguccauaagcaguauucuaucgggcuguauggaacucguaucuaauagaacaggcuccggagggccguugaaacuguaacuguacaaaauugguugaaucaugaucaaugauugaguaagaucuucucucaucagcauaugucgauagaacgacguuucaucaggagaauuauugaaaacuugcaggaacugagaccuccuuagaugguacaugaauugcggauagaggcuaaaguuuuggcccaaucugaaugaaccagcaucgucuuuauuguauucuccgaauuuuugacacaaucgaauc

SEQ ID NO: 1103 - RNA, 352 nt, artificial sequence
  synthetic construct
guaucuaauagaacaggcuccggagggccguugaaacuguaacuguacaaaauugguugaaucaugaucaaugauugaguaagaucuucucucaucagcauaugucgauagaacgacguuucaucaggagaauuauugaaaacuugcaggaacugagaccuccuuagaugguacaugaauugcggauagaggcuaaaguuuuggcccaaucugaaugaaccagcaucgucuuuauuguauucuccgaauuuuugacacaaucgaaucagcauucuaucgacccaucucagaacgucgggacuuucaucugauucagcucuauaaacagccauucuggccauaauuacagcuc

SEQ ID NO: 1104 - RNA, 351 nt, artificial sequence
  synthetic construct
gcacuguaauucccuucgauauuuuucaaauagucuccuuccaaauggucuagcacggcuuuagguaauaaaggagguaaacuuucaguugaagcuguuagaucuggauggcccaacaugucuuuugauuuauacguuuucaaggcccaagaaaguauuguaacguauucguuaccuuugagcccguuuuguauaauuucuuguagauguacagaaagaccaccaugauacauaugaauguauuugucuaauauuuuguaacuugguggaaaacaaggaagacagaguguuuuaacaauucucaaaucuucuaagaucaucauucuaauuaguucuaaauaacguauaagc

SEQ ID NO: 1105 - RNA, 351 nt, artificial sequence
  synthetic construct
guaaaaguucaaauugauauuuacaaguuuuggaaacaacaaaguccuaaaaaucguacuuuuguguagaacuuuagguuuaucuauaugcgcaacuuugucucuaacuucagaccuugauagaucgccucucaaauuuagcaaccucaggagaugaucauccgugauaucgggauauuuuuccacgacucugugaagcucaaacgacaucauaucgucaucacuuuucaauaccuccgagagcauaaugauggcaucgaauggguuuucgcauucgaugucuuugcuaagggucugaaacaaucuguucaaucgguuggccucuuccgacgcuuuuugugcugcuuucgc

SEQ ID NO: 1106 - RNA, 351 nt, artificial sequence
  synthetic construct
guguaacuugguggaaaacaaggaagacagaguguuuuaacaauucucaaaucuucuaagaucaucauucuaauuaguucuaaauaacguauaagccaauguuuauuguccucucuuucuucaacuugaguacccucgauuuuggaugacacggucuucuccaaaauuuuaaaagccauuucucuccauuucuucggucgagcuggaggaaugaauccaguuuguuuuuguugcuuuaaagcuucuucguccgcuuuuucuucucuuucuaugauccgcaaggcuguuacgauuacugucgggucuuuucuuacuguauuuaagguucuagauaaaaugaacguuaguugc

SEQ ID NO: 1107 - RNA, 351 nt, artificial sequence
  synthetic construct
guggaaguaaucuucgaugguuacauaaauuguguccgcaggauuggaagcgaaccaaugugauguaaacaguuugucgaaauguugguccgagucgacaaauaauucuucuaagagauaauggacugccucguuucucauuuuaauauaagucgcuuuuaaugcuccaaaauuccuaguaaguucaugcgaacuguuguuaguaacauauucuuuuuccaauugagaaccuaauucaacaaguugcaggauauuguugauaauuaagaucauguauugaguaaaauauacaacuuguuuccugucuucaaaauauuuauucuugaauucgauaaucgcuucucuaaaagc

SEQ ID NO: 1108 - RNA, 351 nt, artificial sequence
  synthetic construct
gcauuccucuuuuucugauuugagaguguucugcauccauucacuguaauucccuucgauauuuuucaaauagucuccuuccaaauggucuagcacggcuuuagguaauaaaggagguaaacuuucaguugaagcuguuagaucuggauggcccaacaugucuuuugauuuauacguuuucaaggcccaagaaaguauuguaacguauucguuaccuuugagcccguuuuguauaauuucuuguagauguacagaaagaccaccaugauacauaugaauguauuugucuaauauuuuguaacuugguggaaaacaaggaagacagaguguuuuaacaauucucaaaucuuc

SEQ ID NO: 1109 - RNA, 350 nt, artificial sequence
  synthetic construct
guuaguugcuucuccaauaauuucgauaguacuuccacaucggcgaaauaugcuuuuaacaucgauuugucaugcacagauugauuugguaguuuguguaacucaaauaguaggucgucucucgaguucucuaaaucccuuaaacauugauguguaugaagcaauuuuccuucguuaauccaagcuuucguuuucucaacacuuuccggaacaguaaaaauaugcuugagguuuucuuuagcuguuacguauugugaaugacgcauauuuucaucucuaauaucgauaagcuucuugcugaguucaggcacgucggcaaacaauucagacauuuucuucauacuaucauc

SEQ ID NO: 1110 - RNA, 352 nt, artificial sequence
  synthetic construct
guuaguugcuucuccaauaauuucgauaguacuuccacaucggcgaaauaugcuuuuaacaucgauuugucaugcacagauugauuugguaguuuguguaacucaaauaguaggucgucucucgaguucucuaaaucccuuaaacauugauguguaugaagcaauuuuccuucguuaauccaagcuuucguuuucucaacacuuuccggaacaguaaaaauaugcuugagguuuucuuuagcuguuacguauugugaaugacgcauauuuucaucucuaauaucgauaagcuucuugcugaguucaggcacgucggcaaacaauucagacauuuucuucauacuaucaucgc

SEQ ID NO: 1111 - RNA, 351 nt, artificial sequence
  synthetic construct
gcgcaaggcuguuacgauuacugucgggucuuuucuuacuguauuuaagguucuagauaaaaugaacguuaguugcuucuccaauaauuucgauaguacuuccacaucggcgaaauaugcuuuuaacaucgauuugucaugcacagauugauuugguaguuuguguaacucaaauaguaggucgucucucgaguucucuaaaucccuuaaacauugauguguaugaagcaauuuuccuucguuaauccaagcuuucguuuucucaacacuuuccggaacaguaaaaauaugcuugagguuuucuuuagcuguuacguauugugaaugacgcauauuuucaucucuaauauc

SEQ ID NO: 1112 - RNA, 352 nt, artificial sequence
  synthetic construct
guauaagucgcuuuuaaugcuccaaaauuccuaguaaguucaugcgaacuguuguuaguaacauauucuuuuuccaauugagaaccuaauucaacaaguugcaggauauuguugauaauuaagaucauguauugaguaaaauauacaacuuguuuccugucuucaaaauauuuauucuugaauucgauaaucgcuucucuaaaagcaucugcaaauauaauuacuugcuggaugcuuaaauuuaguacuuuuauuguuaauucuucacuuauuguuuuggcuacuugcaaauucugaucaaucauuugaaauauaauaaugggggccgguguccgagaauacgauucugagc

SEQ ID NO: 1113 - RNA, 350 nt, artificial sequence
  synthetic construct
gcccguuuuguauaauuucuuguagauguacagaaagaccaccaugauacauaugaauguauuugucuaauauuuuguaacuugguggaaaacaaggaagacagaguguuuuaacaauucucaaaucuucuaagaucaucauucuaauuaguucuaaauaacguauaagccaauguuuauuguccucucuuucuucaacuugaguacccucgauuuuggaugacacggucuucuccaaaauuuuaaaagccauuucucuccauuucuucggucgagcuggaggaaugaauccaguuuguuuuuguugcuuuaaagcuucuucguccgcuuuuucuucucuuucuaugauc

SEQ ID NO: 1114 - RNA, 352 nt, artificial sequence
  synthetic construct
gcguugaacuagcugaacaguaggaauugguucuuuguaaaccagguaauacuguugggccauuuuacgcgcuugcuugaccaacaaacgguagucgggucccaucccggaauagaccauuccgaugugcuucgugaucauuuccacuuuguggacgcuguguucgucguaaagaauggauuugugcuuguuuuccguggcuauuaccacuccauuugaugcuuuuauuccuacugacggagcaccagccgcuacugccgcuaaagcauauucgauuuggacuaguuuaccugaagggcugaaaguuguuaaagaaaaacuauaacguucagaugacauuuucacaaaugac

SEQ ID NO: 1115 - RNA, 352 nt, artificial sequence
  synthetic construct
guauuccugcaucacaguggcuacacguugaacuagcugaacaguaggaauugguucuuuguaaaccagguaauacuguugggccauuuuacgcgcuugcuugaccaacaaacgguagucgggucccaucccggaauagaccauuccgaugugcuucgugaucauuuccacuuuguggacgcuguguucgucguaaagaauggauuugugcuuguuuuccguggcuauuaccacuccauuugaugcuuuuauuccuacugacggagcaccagccgcuacugccgcuaaagcauauucgauuuggacuaguuuaccugaagggcugaaaguuguuaaagaaaaacuauaacgc

SEQ ID NO: 1116 - RNA, 351 nt, artificial sequence
  synthetic construct
guaaggaauauuugccaaaaaaucuuuuacuguagaaggaucgaaucuccuaaauccuuguggaucgcauaugccaaccucgauguuaucagcggucauuuggcccucgaaacuuucuuuaagcguuaaaauggcggugugcacagcaucauccaauuccaacucuucgcuauaccuuuucucgaggaaggucuucccguugacguaauucuuucccauugcgguggcuuuccaagcgaaauacgccccggaaggaucgcacuggaauaaguaaggccuguuguugucccauccgcagaucaacagggacacuccgaagggucuaacucccccggauugaguguauuccuc

SEQ ID NO: 1117 - RNA, 351 nt, artificial sequence
  synthetic construct
gucggucccaguaggugcaaucagccgcgccuccugccauuguagcuaguagaaaacuguugauuuuuaugauuuucucuacaguuugugauccaaugaauuggccgccaguggcucgggaauccacugcgagcacuacgcccccuuuguacaugaaucccaauguggugguaccguggucgaacuugauuuugaucucacggccguuaucaucuuuggugaaccuugcaaaguuguugcugggaucaggaaaagggggaacagcuaaguucaugccauucuugaaauuggugcaauacuucugcaggcucucgucguaggcgagucgcucguaauccucggaauuguagc

SEQ ID NO: 1118 - RNA, 350 nt, artificial sequence
  synthetic construct
gcaagcgccacccaucuucuccuuuuccuccacaaacuuguaaugcaaguccaugcaaucauuaucaucgaugugcacccagccagucuccuucaugugguacacucuaacaauaccaccugaauaggcgucucugugaguagcgugguaaaucgaucuacgaccuaaaucauaagcuuccucaucggauaagucccauuuguacccagaauccagcaccccgaaagcguaaauggaacccgaaccuacgcugaacacuuucccggcuguccuuagaccuucugaaucgacauaguagaguugaggaccccuuuugucccauccagccagcaucauucccauggacaagc

SEQ ID NO: 1119 - RNA, 352 nt, artificial sequence
  synthetic construct
guuuagcuaauacucggucccaguaggugcaaucagccgcgccuccugccauuguagcuaguagaaaacuguugauuuuuaugauuuucucuacaguuugugauccaaugaauuggccgccaguggcucgggaauccacugcgagcacuacgcccccuuuguacaugaaucccaauguggugguaccguggucgaacuugauuuugaucucacggccguuaucaucuuuggugaaccuugcaaaguuguugcugggaucaggaaaagggggaacagcuaaguucaugccauucuugaaauuggugcaauacuucugcaggcucucgucguaggcgagucgcucguaauccuc

SEQ ID NO: 1120 - RNA, 352 nt, artificial sequence
  synthetic construct
guuguuuagcuaauacucggucccaguaggugcaaucagccgcgccuccugccauuguagcuaguagaaaacuguugauuuuuaugauuuucucuacaguuugugauccaaugaauuggccgccaguggcucgggaauccacugcgagcacuacgcccccuuuguacaugaaucccaauguggugguaccguggucgaacuugauuuugaucucacggccguuaucaucuuuggugaaccuugcaaaguuguugcugggaucaggaaaagggggaacagcuaaguucaugccauucuugaaauuggugcaauacuucugcaggcucucgucguaggcgagucgcucguaauc

SEQ ID NO: 1121 - RNA, 351 nt, artificial sequence
  synthetic construct
gcauucccauggacaagcccauucccuuguaauuauaaaccauguuggccauuaacuuggaagccgcagccaccgagauacguucccuguuucucagcucguacagccuacauuguuuagcuaauacucggucccaguaggugcaaucagccgcgccuccugccauuguagcuaguagaaaacuguugauuuuuaugauuuucucuacaguuugugauccaaugaauuggccgccaguggcucgggaauccacugcgagcacuacgcccccuuuguacaugaaucccaauguggugguaccguggucgaacuugauuuugaucucacggccguuaucaucuuuggugaacc

SEQ ID NO: 1122 - RNA, 351 nt, artificial sequence
  synthetic construct
guuucucagcucguacagccuacauuguuuagcuaauacucggucccaguaggugcaaucagccgcgccuccugccauuguagcuaguagaaaacuguugauuuuuaugauuuucucuacaguuugugauccaaugaauuggccgccaguggcucgggaauccacugcgagcacuacgcccccuuuguacaugaaucccaauguggugguaccguggucgaacuugauuuugaucucacggccguuaucaucuuuggugaaccuugcaaaguuguugcugggaucaggaaaagggggaacagcuaaguucaugccauucuugaaauuggugcaauacuucugcaggcucuc

SEQ ID NO: 1123 - RNA, 352 nt, artificial sequence
  synthetic construct
gcaguaggugcaaucagccgcgccuccugccauuguagcuaguagaaaacuguugauuuuuaugauuuucucuacaguuugugauccaaugaauuggccgccaguggcucgggaauccacugcgagcacuacgcccccuuuguacaugaaucccaauguggugguaccguggucgaacuugauuuugaucucacggccguuaucaucuuuggugaaccuugcaaaguuguugcugggaucaggaaaagggggaacagcuaaguucaugccauucuugaaauuggugcaauacuucugcaggcucucgucguaggcgagucgcucguaauccucggaauuguagcuuguaauc

SEQ ID NO: 1124 - RNA, 352 nt, artificial sequence
  synthetic construct
guaauuauaaaccauguuggccauuaacuuggaagccgcagccaccgagauacguucccuguuucucagcucguacagccuacauuguuuagcuaauacucggucccaguaggugcaaucagccgcgccuccugccauuguagcuaguagaaaacuguugauuuuuaugauuuucucuacaguuugugauccaaugaauuggccgccaguggcucgggaauccacugcgagcacuacgcccccuuuguacaugaaucccaauguggugguaccguggucgaacuugauuuugaucucacggccguuaucaucuuuggugaaccuugcaaaguuguugcugggaucaggaaac

SEQ ID NO: 1125 - RNA, 350 nt, artificial sequence
  synthetic construct
guacccagaauccagcaccccgaaagcguaaauggaacccgaaccuacgcugaacacuuucccggcuguccuuagaccuucugaaucgacauaguagaguugaggaccccuuuugucccauccagccagcaucauucccauggacaagcccauucccuuguaauuauaaaccauguuggccauuaacuuggaagccgcagccaccgagauacguucccuguuucucagcucguacagccuacauuguuuagcuaauacucggucccaguaggugcaaucagccgcgccuccugccauuguagcuaguagaaaacuguugauuuuuaugauuuucucuacaguuugugauc

SEQ ID NO: 1126 - RNA, 351 nt, artificial sequence
  synthetic construct
guauuuuuuaguagcagcggcagcuucgucuucccgcugguaauucugcaaaacuuccugcuucuucguagcgauacguucuucgcgucucucccuggcccguuucaccuucauucucuuggcguucgccuggucggccaacaucuuggcgcgcgccuucucggccuucuucuuguggauguauuccaucaggacgcgcuuguucuugaacacguuacccuucgccuucauguacagcgaaugguacagaugccugucgauuuucuuggccucgcgguacuucuucaacaaacgacggagcacccucauacguugaauccauaauucuuuucuugguguucgagcguucgc

SEQ ID NO: 1127 - RNA, 351 nt, artificial sequence
  synthetic construct
guuacccuucgccuucauguacagcgaaugguacagaugccugucgauuuucuuggccucgcgguacuucuucaacaaacgacggagcacccucauacguugaauccauaauucuuuucuugguguucgagcguucgcuguaccuuuccuuuuaccgaaaccgcagugccugcccuuccugcgggcuucgguguucuugcggacgcgggcgcgcgagugcaccgccacgggcuucuugaugaucagaccgucuuugaucagcuugcggauguuuugucgugaauuuguguuggcgauuucguugauuucguugggauccaaccauaccuucuuuuugccgcaucucauaac

SEQ ID NO: 1128 - RNA, 352 nt, artificial sequence
  synthetic construct
gucgauuuucuuggccucgcgguacuucuucaacaaacgacggagcacccucauacguugaauccauaauucuuuucuugguguucgagcguucgcuguaccuuuccuuuuaccgaaaccgcagugccugcccuuccugcgggcuucgguguucuugcggacgcgggcgcgcgagugcaccgccacgggcuucuugaugaucagaccgucuuugaucagcuugcggauguuuugucgugaauuuguguuggcgauuucguugauuucguugggauccaaccauaccuucuuuuugccgcaucucauaacagaggcugcgagccucuucuggaguuuuaacgaacucauuuuc

SEQ ID NO: 1129 - RNA, 351 nt, artificial sequence
  synthetic construct
gaugccugucgauuuucuuggccucgcgguacuucuucaacaaacgacggagcacccucauacguugaauccauaauucuuuucuugguguucgagcguucgcuguaccuuuccuuuuaccgaaaccgcagugccugcccuuccugcgggcuucgguguucuugcggacgcgggcgcgcgagugcaccgccacgggcuucuugaugaucagaccgucuuugaucagcuugcggauguuuugucgugaauuuguguuggcgauuucguugauuucguugggauccaaccauaccuucuuuuugccgcaucucauaacagaggcugcgagccucuucuggaguuuuaacgaac

SEQ ID NO: 1130 - RNA, 350 nt, artificial sequence
  synthetic construct
gccuucauguacagcgaaugguacagaugccugucgauuuucuuggccucgcgguacuucuucaacaaacgacggagcacccucauacguugaauccauaauucuuuucuugguguucgagcguucgcuguaccuuuccuuuuaccgaaaccgcagugccugcccuuccugcgggcuucgguguucuugcggacgcgggcgcgcgagugcaccgccacgggcuucuugaugaucagaccgucuuugaucagcuugcggauguuuugucgugaauuuguguuggcgauuucguugauuucguugggauccaaccauaccuucuuuuugccgcaucucauaacagaggcugc

SEQ ID NO: 1131 - RNA, 352 nt, artificial sequence
  synthetic construct
guacccuucgccuucauguacagcgaaugguacagaugccugucgauuuucuuggccucgcgguacuucuucaacaaacgacggagcacccucauacguugaauccauaauucuuuucuugguguucgagcguucgcuguaccuuuccuuuuaccgaaaccgcagugccugcccuuccugcgggcuucgguguucuugcggacgcgggcgcgcgagugcaccgccacgggcuucuugaugaucagaccgucuuugaucagcuugcggauguuuugucgugaauuuguguuggcgauuucguugauuucguugggauccaaccauaccuucuuuuugccgcaucucauaacac

SEQ ID NO: 1132 - RNA, 351 nt, artificial sequence
  synthetic construct
guaacucgaagcagcagcugcagcuggagccgcagucuugucuucuuccuuaacucuaucuuucuuaaggggucccaugaacgcagccuugucggcggcgguuuggaaucuaccguguccgaauuuggacgacguaucgaugaauuucaaauugaucuucuccaaagcaauacgcuuagugugaaccaagagagauuuucucaguguaaugacgcgcuucuuagguccaauacaacaacccuuaaucaugacgaagucguuguuaacuucaccguaaugagggaaaccacccaucgguguaauaguuuucucacuaagaucguaaucgguagcagcauuguuuuugaugac

SEQ ID NO: 1133 - RNA, 351 nt, artificial sequence
  synthetic construct
gcuucguaugccaacgagauguaacaccuuuguauccaugaccuuugguuacaccgaugcaaucgaucaucucaucuugagcgaaaacguugccaacgggaaugggcuucuccaaaugcuccuuagcccaugccacuuugucggcaaugguaccgccguugaguugaauuuccauaaugugggcuuucuuuuggcguuguuucaacaauuucaucugagugugagcgaugacucugacaaccuugcaguauuugacgauuuucuucaagucgcgcucaauugacuuuuuacccaaaucgucgguccauuucuuggaugccuuggugaaggccuucuucuugcucuuguacc

SEQ ID NO: 1134 - RNA, 352 nt, artificial sequence
  synthetic construct
guuccuuaacucuaucuuucuuaaggggucccaugaacgcagccuugucggcggcgguuuggaaucuaccguguccgaauuuggacgacguaucgaugaauuucaaauugaucuucuccaaagcaauacgcuuagugugaaccaagagagauuuucucaguguaaugacgcgcuucuuagguccaauacaacaacccuuaaucaugacgaagucguuguuaacuucaccguaaugagggaaaccacccaucgguguaauaguuuucucacuaagaucguaaucgguagcagcauuguuuuugaugaccuuuccguccuuagugugaauuccagcgccgauucuguagauuuc

SEQ ID NO: 1135 - RNA, 352 nt, artificial sequence
  synthetic construct
guuucaaauugaucuucuccaaagcaauacgcuuagugugaaccaagagagauuuucucaguguaaugacgcgcuucuuagguccaauacaacaacccuuaaucaugacgaagucguuguuaacuucaccguaaugagggaaaccacccaucgguguaauaguuuucucacuaagaucguaaucgguagcagcauuguuuuugaugaccuuuccguccuuagugugaauuccagcgccgauucuguagauuuucuuguucaucuccguccugugaugguaacccuuuugaccagcacgagcgacagugaacgacacucgagaaggaugccaggcuccaauacaggcgacuuc

SEQ ID NO: 1136 - RNA, 352 nt, artificial sequence
  synthetic construct
guugucuucuuccuuaacucuaucuuucuuaaggggucccaugaacgcagccuugucggcggcgguuuggaaucuaccguguccgaauuuggacgacguaucgaugaauuucaaauugaucuucuccaaagcaauacgcuuagugugaaccaagagagauuuucucaguguaaugacgcgcuucuuagguccaauacaacaacccuuaaucaugacgaagucguuguuaacuucaccguaaugagggaaaccacccaucgguguaauaguuuucucacuaagaucguaaucgguagcagcauuguuuuugaugaccuuuccguccuuagugugaauuccagcgccgauucuc

SEQ ID NO: 1137 - RNA, 350 nt, artificial sequence
  synthetic construct
gcaaugguaccgccguugaguugaauuuccauaaugugggcuuucuuuuggcguuguuucaacaauuucaucugagugugagcgaugacucugacaaccuugcaguauuugacgauuuucuucaagucgcgcucaauugacuuuuuacccaaaucgucgguccauuucuuggaugccuuggugaaggccuucuucuugcucuuguaccaguucuuguagaaacgucuacggcaaucuucagacaaauguucagcccaaacgguggccaaagcccucaugccauguggaguuucgauguaacccacaacgccuacuacaaucaucggagggguuuccaaaauggucacagc

SEQ ID NO: 1138 - RNA, 352 nt, artificial sequence
  synthetic construct
gaugacucugacaaccuugcaguauuugacgauuuucuucaagucgcgcucaauugacuuuuuacccaaaucgucgguccauuucuuggaugccuuggugaaggccuucuucuugcucuuguaccaguucuuguagaaacgucuacggcaaucuucagacaaauguucagcccaaacgguggccaaagcccucaugccauguggaguuucgauguaacccacaacgccuacuacaaucaucggagggguuuccaaaauggucacagccucuacgauuuccuucuuguugauuuucgaaccaggccugucugccucacguagcacgugggucauaccggcuuuguagccaauc

SEQ ID NO: 1139 - RNA, 349 nt, artificial sequence
  synthetic construct
ggaggaauucccucuuugucuugaauuuuggccuuaacauuuucgauaguaucagaugguucaacuucaagaguaauuguuuuaccaguaagaguuuuaacgaauauuugcauuccuccacguagacgaagaacuaaaugcaguguggacucuuuuugaauauuguagucagacaauguucugccaucuuccaguuguuuaccggcgaagauuaaacguugcugaucuggaggaauccccucuuugucuuggauuuucgccuuaacguucucaauaguaucagaugguucaacuucgaggguuauaguuuuaccaguaaggguuuuaacgaauauuugcaucccuccac

SEQ ID NO: 1140 - RNA, 352 nt, artificial sequence
  synthetic construct
guaacauuuucgauaguaucagaugguucaacuucaagaguaauuguuuuaccaguaagaguuuuaacgaauauuugcauuccuccacguagacgaagaacuaaaugcaguguggacucuuuuugaauauuguagucagacaauguucugccaucuuccaguuguuuaccggcgaagauuaaacguugcugaucuggaggaauccccucuuugucuuggauuuucgccuuaacguucucaauaguaucagaugguucaacuucgaggguuauaguuuuaccaguaaggguuuuaacgaauauuugcaucccuccacggagacgaaguacuaaauguagaguagauucuuuuc

SEQ ID NO: 1141 - RNA, 351 nt, artificial sequence
  synthetic construct
guucaacuucaagaguaauuguuuuaccaguaagaguuuuaacgaauauuugcauuccuccacguagacgaagaacuaaaugcaguguggacucuuuuugaauauuguagucagacaauguucugccaucuuccaguuguuuaccggcgaagauuaaacguugcugaucuggaggaauccccucuuugucuuggauuuucgccuuaacguucucaauaguaucagaugguucaacuucgaggguuauaguuuuaccaguaaggguuuuaacgaauauuugcaucccuccacggagacgaaguacuaaauguagaguagauucuuuuugaauauuguagucagauaagguuc

SEQ ID NO: 1142 - RNA, 350 nt, artificial sequence
  synthetic construct
gaguaauuguuuuaccaguaagaguuuuaacgaauauuugcauuccuccacguagacgaagaacuaaaugcaguguggacucuuuuugaauauuguagucagacaauguucugccaucuuccaguuguuuaccggcgaagauuaaacguugcugaucuggaggaauccccucuuugucuuggauuuucgccuuaacguucucaauaguaucagaugguucaacuucgaggguuauaguuuuaccaguaaggguuuuaacgaauauuugcaucccuccacggagacgaaguacuaaauguagaguagauucuuuuugaauauuguagucagauaagguucuuccaucuucc

SEQ ID NO: 1143 - RNA, 256 nt, artificial sequence
  synthetic construct
guagaaguuuuuggcuaagauuccaucuuucuucguuaaccucacaauacaaucguccgauucucccauacgccugauagcuccgcagagggcguagcuuuuggaacuuucggucauccuuccgguuaaaggaucgacaucggcuacgcugaguugaaugcuagcgugguccuuagcaugaauaauucuguugcuagcagagcauuuccuugggcaguacaagucgacgguuucaccagcgucguuuuccauguuc

SEQ ID NO: 1144 - RNA, 351 nt, artificial sequence
  synthetic construct
guaguguguuuuugcagcuagccuuuuaucccuuucuucggcuauggacaacuuaacacccuuaccucuuggaagagauacaaaggcuuuagcuccuuuaccaaucacgaauacauuauuuaaucuaguugcaaaagcaugaccauuggcguccuuaauguguacaauaucgaaggaaccgggaugacgcucccuguucauaauuguaccaacacgucccaaauuucuaccuccgguaaucaugcacaaguuguuugauucaaacuugauguaauccagaauuuucgacguagcgaucucuaguugaauggugucauucaccuugauauuaggaucaggauaacggauggc

SEQ ID NO: 1145 - RNA, 351 nt, artificial sequence
  synthetic construct
gaugaccauuggcguccuuaauguguacaauaucgaaggaaccgggaugacgcucccuguucauaauuguaccaacacgucccaaauuucuaccuccgguaaucaugcacaaguuguuugauucaaacuugauguaauccagaauuuucgacguagcgaucucuaguugaauggugucauucaccuugauauuaggaucaggauaacggaugguacguccaucaugggucaccaaaaacggaauuccuuucggaccaguuugaacccucuuaacuuugcacaguuuguauuuagcuucuucagcaguaauacggugaauagcgaaucugccuuuuacaucauagaugagac

SEQ ID NO: 1146 - RNA, 352 nt, artificial sequence
  synthetic construct
gcaaucacgaauacauuauuuaaucuaguugcaaaagcaugaccauuggcguccuuaauguguacaauaucgaaggaaccgggaugacgcucccuguucauaauuguaccaacacgucccaaauuucuaccuccgguaaucaugcacaaguuguuugauucaaacuugauguaauccagaauuuucgacguagcgaucucuaguugaauggugucauucaccuugauauuaggaucaggauaacggaugguacguccaucaugggucaccaaaaacggaauuccuuucggaccaguuugaacccucuuaacuuugcacaguuuguauuuagcuucuucagcaguaauacggc

SEQ ID NO: 1147 - RNA, 351 nt, artificial sequence
  synthetic construct
gugacgcucccuguucauaauuguaccaacacgucccaaauuucuaccuccgguaaucaugcacaaguuguuugauucaaacuugauguaauccagaauuuucgacguagcgaucucuaguugaauggugucauucaccuugauauuaggaucaggauaacggaugguacguccaucaugggucaccaaaaacggaauuccuuucggaccaguuugaacccucuuaacuuugcacaguuuguauuuagcuucuucagcaguaauacggugaauagcgaaucugccuuuuacaucauagaugagacggaagaauucaccaguuuucucaauggugauaacauccauaaaacc

SEQ ID NO: 1148 - RNA, 352 nt, artificial sequence
  synthetic construct
gugaccauuggcguccuuaauguguacaauaucgaaggaaccgggaugacgcucccuguucauaauuguaccaacacgucccaaauuucuaccuccgguaaucaugcacaaguuguuugauucaaacuugauguaauccagaauuuucgacguagcgaucucuaguugaauggugucauucaccuugauauuaggaucaggauaacggaugguacguccaucaugggucaccaaaaacggaauuccuuucggaccaguuugaacccucuuaacuuugcacaguuuguauuuagcuucuucagcaguaauacggugaauagcgaaucugccuuuuacaucauagaugagacgc

SEQ ID NO: 1149 - RNA, 351 nt, artificial sequence
  synthetic construct
gaccauuggcguccuuaauguguacaauaucgaaggaaccgggaugacgcucccuguucauaauuguaccaacacgucccaaauuucuaccuccgguaaucaugcacaaguuguuugauucaaacuugauguaauccagaauuuucgacguagcgaucucuaguugaauggugucauucaccuugauauuaggaucaggauaacggaugguacguccaucaugggucaccaaaaacggaauuccuuucggaccaguuugaacccucuuaacuuugcacaguuuguauuuagcuucuucagcaguaauacggugaauagcgaaucugccuuuuacaucauagaugagacggc

SEQ ID NO: 1150 - RNA, 351 nt, artificial sequence
  synthetic construct
gaaggaaccgggaugacgcucccuguucauaauuguaccaacacgucccaaauuucuaccuccgguaaucaugcacaaguuguuugauucaaacuugauguaauccagaauuuucgacguagcgaucucuaguugaauggugucauucaccuugauauuaggaucaggauaacggaugguacguccaucaugggucaccaaaaacggaauuccuuucggaccaguuugaacccucuuaacuuugcacaguuuguauuuagcuucuucagcaguaauacggugaauagcgaaucugccuuuuacaucauagaugagacggaagaauucaccaguuuucucaauggugauaac

SEQ ID NO: 1151 - RNA, 350 nt, artificial sequence
  synthetic construct
gaaccgggaugacgcucccuguucauaauuguaccaacacgucccaaauuucuaccuccgguaaucaugcacaaguuguuugauucaaacuugauguaauccagaauuuucgacguagcgaucucuaguugaauggugucauucaccuugauauuaggaucaggauaacggaugguacguccaucaugggucaccaaaaacggaauuccuuucggaccaguuugaacccucuuaacuuugcacaguuuguauuuagcuucuucagcaguaauacggugaauagcgaaucugccuuuuacaucauagaugagacggaagaauucaccaguuuucucaauggugauaacauc

SEQ ID NO: 1152 - RNA, 351 nt, artificial sequence
  synthetic construct
gcggguuccaccaauuccucuucaccagguuucaaauugcgaaccauaauaaucccuccgaucgaaacauccuucauugcaacguauugcgaguuaucauuaagcguaaucacuuucagcuguugccucaugguccuggcaggauuuugcaggauuucgaaacuaggcucgggcuccuuuuucuucuccuccuuaucaucuuucuuaucuuuuuugucgucgcucgacgacgccgcuuuuuuaucgucgguuuucuuaucaucggacuuuuucuccucuuucuucucuucgguuuucuucuccuucuccuccuucucgggcuucuuaucgucuuuaucuucguccacaucc

SEQ ID NO: 1153 - RNA, 350 nt, artificial sequence
  synthetic construct
guuccuuuucaucaucgcccuuuggaccgaaugcugcuacggguuccaccaauuccucuucaccagguuucaaauugcgaaccauaauaaucccuccgaucgaaacauccuucauugcaacguauugcgaguuaucauuaagcguaaucacuuucagcuguugccucaugguccuggcaggauuuugcaggauuucgaaacuaggcucgggcuccuuuuucuucuccuccuuaucaucuuucuuaucuuuuuugucgucgcucgacgacgccgcuuuuuuaucgucgguuuucuuaucaucggacuuuuucuccucuuucuucucuucgguuuucuucuccuucuccucc

SEQ ID NO: 1154 - RNA, 350 nt, artificial sequence
  synthetic construct
gcugcuacggguuccaccaauuccucuucaccagguuucaaauugcgaaccauaauaaucccuccgaucgaaacauccuucauugcaacguauugcgaguuaucauuaagcguaaucacuuucagcuguugccucaugguccuggcaggauuuugcaggauuucgaaacuaggcucgggcuccuuuuucuucuccuccuuaucaucuuucuuaucuuuuuugucgucgcucgacgacgccgcuuuuuuaucgucgguuuucuuaucaucggacuuuuucuccucuuucuucucuucgguuuucuucuccuucuccuccuucucgggcuucuuaucgucuuuaucuucguc

SEQ ID NO: 1155 - RNA, 351 nt, artificial sequence
  synthetic construct
guacaugccggaucuucucaggauuggauccuuaucagaaguaagcuguuguauuaggguaucagcuucuucuaaucggccguacaucgugaagcuuauaccaacagccaaaccgcgaagaaucuuuucguguugacucucuugcgcguacgcuaccauauccauaaucguaguggaauuacuggauccuaacauaaccaugcccaucgcaauuccagcggccucuccgguauuagcaucaucuugauagagauugaacuucagcuguucguagacaucuugccuguguguccccauggcagccaaaccaagcccuaaacaaccgccgugccuaaccaucucauucugagc

SEQ ID NO: 1156 - RNA, 247 nt, artificial sequence
  synthetic construct
gucccaucccggaauagaccauuccgaugugcuucgugaucauuucuacuuuauggacgcuguguucgucguaaagaauggauuugugcuuguuuucuguggcuauuaccacuccauuugaugcuuuuauuccuacugaaggagcaccagccgccacugccgcuaaagcauauucgauuuggacuaguuuaccugaagggcugaaaguuguuaaagaaaaacuauaacguucagaugacauuuucac

SEQ ID NO: 1157 - RNA, 247 nt, artificial sequence
  synthetic construct
gcgccacccauuuucuccuuuuccuccacaaacuuguaaugcaaguccaugcaaucauuaucaucgaugugcacccaaccagucucuuucaugugguacacucuaacaauaccuccugaauaggcgucucuaugaguagcgugguaaaucgaucuacgaccuaaaucauaagcuuccucaucggauaagucccauuuguauccagaaucaagcaccccgaaagcguaaauggaaccugaaccuacgc

SEQ ID NO: 1158 - RNA, 259 nt, artificial sequence
  synthetic construct
guacuuuuucaacaaacgacgaaggacucucauacguugaauccauaauucuuuucuugguguucgagcguucgcuguaccuuuccuuuuaccaaaaccgcagugccuacccuuccugcgggcuucgguguucuugcggacacgggcacgugagugcacugcuacaggcuucuugaugaucaaaccaucuuuaaucagcuugcggauguuuugucuugaauuuguauuggcgauuucguugauuucguuaggauccaac

SEQ ID NO: 1159 - RNA, 268 nt, artificial sequence
  synthetic construct
gucuucuuccuuaacucuaucuuucuuaagaggucccauaaacgcagccuugucggcggcgguuuggaaucuaccguguccgaauuuggacgacguaucgaugaauuucaaauugaucuucuccaaagcaauacgcuuagugugaaccaagagagauuuucucaguguaaugacacgcuucuuaggucccauacaacaacccuuaaucaugacgaagucauuguuaacuucaccauaaugagggaaaccacccauugguguaaugguc

SEQ ID NO: 1160 - RNA, 249 nt, artificial sequence
  synthetic construct
gauaagguucuuccaucuuccaguuguuugccagcgaaaauuaaacguugcugaucuggaggaauacccucuuugucuuggauuuucgccuucacguucucaauaguaucagaugguucaacuucgagggugauaguuuuaccaguaaggguuuuaacgaauauuugcaucccaccacggagacgaagaacuaagugcaauguggacucuuucugaauguuguagucagacaagguucuuccaucuucc

SEQ ID NO: 1161 - RNA, 247 nt, artificial sequence
  synthetic construct
gaaguuuuuggcuaggauuccaucuuucuucguuaaccucacaauacaaucguccgauucucccauacgccugauagcuccgcagagagcguagcucuuggaacuuucggucauucuuccgguuaaaggaucaacgucggcgacgcugaguugaaugcuagcgugguccuuagcaugaauaauucuguugcuagcagagcauuuucuugggcaguacaagucgacgguuucaccagcgucguuuucc

SEQ ID NO: 1162 - RNA, 266 nt, artificial sequence
  synthetic construct
gacguagcgaucuccaauugaauugugucguuuaccuugaugacaggaucaggguaacggauuguacgaccaucgugggucaccaaaaacggaauuccuuugggaccgguuugaacccucuuaacuuugcaaagcuuguauuuagcuucuucagcaguaauacgguggauagcaaaucuuccuuucacaucauagaugagacggaaaaauucaccaguuuuuucaauggugauaacauccauaaaaccugcgggguaguuggaguc

SEQ ID NO: 1163 - RNA, 258 nt, artificial sequence
  synthetic construct
gauagaaacauccuucauugcaacguauugcgaguuaucauuaagcguaaucacuuucaguuguugccucaugguccuggcaggauuuugcaagauuucgaaacuaggcucgggcuccuuuuucuucuccuccuuaucaucuuucuuaucuuuuuugucgucgcucgacgacgccgcuuuuuuaucgucgguuuucuuaucaucggacuuuuucuccucuuucuugucuucgguuuucuucucuuucuccuccuuuuc

SEQ ID NO: 1164 - RNA, 230 nt, artificial sequence
  synthetic construct
gacauauucuucucugaauccuucugcaugaccuuggccacagccauuucgaaaucuucuuggguuacguguacccuucucucccuuagggcguacaugccugccucaguacacacucccuucacuucggcaccgcuggcaccuggcaucaauucggcgauuuuccucaaauugaucccucuggucaaauucauuuuucucgagugaauuuucaagauguccaaucgggc

SEQ ID NO: 1165 - RNA, 252 nt, artificial sequence
  synthetic construct
gccguugaaacuguaacuguacaaaauugguugaaucaugaucaaugauugaguaagaucuucucucaucaacauaugucuauagaacgacguuucaucaggagaauuauugaaaacuugcaagaacugagaccuccuuagaugguacaugaauugcggauagaggcuaaaguuuuggccuaaucugaaugaaccagcaucgucuuuauuguauucuccgaauuuuugacacaaucgaaucagcauucuauc

SEQ ID NO: 1166 - RNA, 273 nt, artificial sequence
  synthetic construct
gcuuucuaauucauccucguccaaaucaucagcgaagccuaccggcuggcuaauagcaguaguaaucucguuggcaaugucaugcuguucagcuaugucauccaugaugucguggacaucaucgacauucaaguuuuugugggcuuuuuggagagcuucagcugcauucuucauugaaucuaagacggcuguguuggugcuggcuccuucgagggccucccuuugcauuucgauuguagugagugugccaucgauuuguaauugaguuuuuuc

SEQ ID NO: 1167 - RNA, 267 nt, artificial sequence
  synthetic construct
gucccuuugaugauaagcuaugucggcggccucuuccaagcacccggcuuugaugcaguauuugacuuugaugucgucgccgacuuugggcagauauuugagggccuccugccguuuguccugccucaagcaaacguccacgaagggagcguauccgauaggggacuucuucgcuuuggaaaacuuuuccagcucgauccaaucguucugaucggccaggcuguugauuuucaaccaccaauaccuuuuaucgggaauuuugaaguc

SEQ ID NO: 1168 - RNA, 255 nt, artificial sequence
  synthetic construct
gucuucucucacuuucaacaccuucaaucuggccugguucagcauguuggacgauuggauuuucuucuggagcucgacuuguuucuccuucuucucguaguauuccaugaucuugaggcgcugcuguuggaccaaacggcccuuuucuauguugaacuccuccucggcuuuggcaucgauuucuucggccuucucguuggccucuugcucgaugaaagccaucaugugcuugaucuguuucuggacaucugcguc

SEQ ID NO: 1169 - RNA, 267 nt, artificial sequence
  synthetic construct
guacaucccaaucauguucuucaacauacccacgguuuuguagaagggacagaaucuaucguacgaugaguacgaguucuguugcaggaaaucuucuuucaacagcuuggcgauuuccaauguaaucuuaucagcuucagcuaaugaagcuuuuccuaccagcugcacgauuuccguaaggucgucuucuucuugaaggauuucuuuaacuuugguucuuagcgguauaaauucagggaaguuuuugucauagaaaucauccaaagc

SEQ ID NO: 1170 - RNA, 252 nt, artificial sequence
  synthetic construct
ggccacuuucacguuagccuugauauugcagaaauccuucggcgccagaacgaccggcugaggcuucuccaccaacuucaaaucgcccagagucgccaacuccagaguacaauucugcagcgugucgcucguuugguucaccaccaacacguccagcacgauaucguacugauuaacgugcacauacgcuucggaguaaacaggauccgagaaacccgucaacugggcgaucuuguucaauuuacucgagcc

SEQ ID NO: 1171 - RNA, 256 nt, artificial sequence
  synthetic construct
guaugggacaaaaggacuccuacguaggagacgaggcccaaagcaaaagagguauccucacuuugaaauaccccaucgaacacgguaucaucaccaacugggaugacauggaaaagaucuggcaccacaccuucuacaacgaacuccgugucgcuccggaagaacaccccguccucuugaccgaggcuccucuuaacccuaaagccaacagggaaaagaugacccaaaucauguuugaaaccuucaacacaccggc

SEQ ID NO: 1172 - RNA, 284 nt, artificial sequence
  synthetic construct
ggaacgucuucccguugacauaauucuuucccauugcgguggcuuuccaagcgaaauacgccccagaaggaucgcacuggaauaaguaaggccuguuguugucccauccgcagaucaauagggacacuccgaagggucuaacucccccggauugaguguauuccugcauuacaguugcaacacguugaacuagcugaacaguaggaauugguucuuuguaaaccagguaauacuguugggccauuuuacgugcuugcuugaccaacaaacgguagucagguccc

SEQ ID NO: 1173 - RNA, 296 nt, artificial sequence
  synthetic construct
ggaccccuuuugucccauccagccaacaucauucccauggacaaacccauuccuuuguaauuauaaaccauauuggccauuaacuuggaagccgcagccaccgaaauacguucccuguuucucaguucguacagccuacauuguuuagcuaauacucggucccaguacguacaaucagccgcgccuccugccauuguagcuagcaaaaaacuguugauuuuuaugauuuuuucuacaguuugugauccaaugaauuggccuccaguggcucgggaauccacugcgaguacuacgcc

SEQ ID NO: 1174 - RNA, 253 nt, artificial sequence
  synthetic construct
ggcagcuucgucuucccucugguaauucugcaaaacuuccugcuucuucguagcgauacguucuucacgucuuucccuggcgcguuugaccuucauucucuuggcguucgccuggucggccaacaucuuggcgcgagccuucucagccuucuucuuguggauguauuccaucaggacacgcuuguucuugaauacguuacccuuugccuucauguacagcgaaugguacagaugucugucgauuuucuuggcc

SEQ ID NO: 1175 - RNA, 301 nt, artificial sequence
  synthetic construct
ggguaagaaguccauugagcgcgacuugaagaaaaucgucaaauacugcaagguugucagagucaucgcucacacucagaugaaauuguugaaacaacgucaaaagaaagcccauauuauggaaauucaacucaacggagguaccauugccgacaaagucgcaugggcuaaggagcauuuggagaagcccauucccguuggcaacguuuucgcucaagaugagaugaucgauugcaucgguguaaccaaaggucauggauacaaagguguuacaucucguuggcauacgaagaaauugccc

SEQ ID NO: 1176 - RNA, 185 nt, artificial sequence
  synthetic construct
guuuuaguuauuaaagaguuuuaacgaauauuuacaucccuccacggagacgaaguacuaaauguagaguagauucuuuuugaauauuguagucagauaagguucuuccaucuuccaguuguuugccagcgaaaauuaaacguugcugaucuggaggaauacccucuuugucuuggauuuucgcc

SEQ ID NO: 1177 - RNA, 255 nt, artificial sequence
  synthetic construct
ggcaauggauagcuucacaccuuuaccucuuggaagagacacaaaagccuuagcuccuuuaccaauuacgaauacauuauuuaaccuaguagcaaaggcaugaccguuagcauccuuaauauguacaauaucgaaggauccaggaugacguucccuguucaugaucguaccgacacgacccaaauuucuaccuccggugaucauacacaaguuguuggauucaaacuugauguaaucgagaauuuuagacguagc

SEQ ID NO: 1178 - RNA, 300 nt, artificial sequence
  synthetic construct
guguucacgcaguauugguauugguucccucugucgcauugucuggcuuuagcuuuuaccccgacgugcguuauagcguugaauacucaacugaagaugccuaaauuggaguucaaaucgaacgcgaaaccgagcuuguacgccuacccggcgcccauggaggaaaagaaacgcgaggaaagggagaaagucaccaccgccguauugagcauagcugcgaggcaaaggagaagggaucacgagaggaaacaucgcgaugagaaaauggauguggacgaagauaaagacgauaagaaaacc

SEQ ID NO: 1179 - RNA, 279 nt, artificial sequence
  synthetic construct
gggcuuccucguucgguggagggaacucgaucuuccugucaauucugccgggccugaguaaagcgggauccaaaaugucgauucuguuuguagccauuauaacuuuaauguucuucguagccucaaauccaucgaguugauucagcaacuccagcauaguucuuugaacuucggaaucgccaccagaaccugauucgauacgagaggauccaauagaaucgauuucauccaugaaaaugaucgaaggggcaugcucccuagccauuacgaacaguuccc

SEQ ID NO: 1180 - RNA, 226 nt, artificial sequence
  synthetic construct
gaaucagcauucuaucgacccaucucagaacgucgggacucucaucugauucagcucuauaaacagccauucuggccauaauuacagcugcugcuuccugaucaaaaccagcgcugaugugguggauauuaguaguggcaucagcccaguuucgagccacuguugucacucuaauucuucuuugaccacuugaguguugauacugaguaaugaauuguaugcaacc

SEQ ID NO: 1181 - RNA, 197 nt, artificial sequence
  synthetic construct
guuauuaauccaugcgaguuccucuuaugaagcccaagcuuccaauucuuucaugucaucaucauccuccacuuuuuuagcagcagguuuaacgggcuuggcaauagcuccuguagguacagcagguaguucaguugggccuggaacuuucagcaaaucuuccucuaauccuucuuguucgagcuuuucuaguucgc

SEQ ID NO: 1182 - RNA, 300 nt, artificial sequence
  synthetic construct
gaucuucacuuuauucuucagcgccagcaaaucgaucccuccgguggucuccugcgacaagugcgacucaucgucgaucuucaagugcaccucuuugcccgugauguccuuguacuugguuugcacguugcccagaaucgacuugaccagcucccuguccugcgggcgcacccugaccguuacuucuuucucgaacagcugguagaguccuugaaggaugaggcuuucgaugauguggccguacuuucccuggucucgggugacuucgccgaggcgcuugcgggcgucuucuagcacggc

SEQ ID NO: 1183 - RNA, 235 nt, artificial sequence
  synthetic construct
gauauggcgagacacgccguggagucgacugcucaaucugagaacaagaucacguggacggugaucagggauucgaugagcaacauuuuguaccaauugagcaguaugaaguucaaggauccggugaaagauggcgaggcgaagaucaaggcggauuucgaucaguuguacgaggauauccagcaggcguucagaaaucuggaggauuaauucgucgcagguguuaggauuucuc

SEQ ID NO: 1184 - RNA, 272 nt, artificial sequence
  synthetic construct
gcgccuucucugaugucaggcacuucauguuaguacucuucagcagaugcuccagguacucguugagauccgucagcggcguauugacggucaccuuauucucccauucgaauucagcccacauccucauaaacuccgaaucggugcacgaugccggaacaauguaauccauaauaucgauguguaugucguucaaaacgacuacauuccuguccgaagcggcgccugucacgucguacacgauguuaccgaauaugauaccauucucgguc

SEQ ID NO: 1185 - RNA, 270 nt, artificial sequence
  synthetic construct
ggagguggaggcggcggcgguggccauuuccuguucgaagucgagggcgacauagcagaguuucuccuugaugucgcggacgauuucccuuucagcggugguggugaacgaguaaccccuuucggugaggauuuucaugagguagucggucaaaucgcgaccggccaaguccaaacggaggauggcguggggaagagcguaaccuucguagaucgguacgguguggguuacaccgucaccggaguccaauacaauaccggugguacgacc

SEQ ID NO: 1186 - RNA, 333 nt, artificial sequence
  synthetic construct
gugcuaauccucaauccaaucguauccuuuccaacuuccgccacuuugcaaauauuacacaauaccccuuuauauuuagguaaauaagaaguaccgcauaauggacauuucucuucagccuuuccccuauaaauagguguauaagagugcccacacaaguugaaaggauugugcucgucauacugcaauugcaaaucaucuguaagauucgaaucgcaagccugcaauauuuuccucgcuugcugggcuacuucaggccuaggaccgaguucuaacagccucuuggcgaaagaagcagcaguuuuguaguuuuugagcuugaagaacauguuc

SEQ ID NO: 1187 - RNA, 352 nt, artificial sequence
  synthetic construct
gagaugauuucuuuuugcuucgugaguguacgaaccaucgcauucacccacuauuggagagcaaccaauuggcaaaggaauuguaauguuaacguccacuaauucuaaguuagugugggcaaguucguauucaauauucacaucgcaacugccgucuccugcuucagaaggccaacaguuuauuagcagaggcaccagggcuucgucaguacuuugcaaucgccauuuuaauacaccuacgucaguguggagcgggaaugguuucgaaggcuguuuuaaaccaauuucugaacgcaauuugaacaguucuuuaucgacauucgggugcguuugaagcugcacuccgugcguc

SEQ ID NO: 1188 - RNA, 351 nt, artificial sequence
  synthetic construct
gugaauucuaaagaacccgucuuguugcuagcaucaauuaccggcagguuccauacaagaugauuucuuuuugcuucgugaguguacgaaccaucgcauucacccacuauuggagagcaaccaauuggcaaaggaauuguaauguuaacguccacuaauucuaaguuagugugggcaaguucguauucaauauucacaucgcaacugccgucuccugcuucagaaggccaacaguuuauuagcagaggcaccagggcuucgucaguacuuugcaaucgccauuuuaauacaccuacgucaguguggagcgggaaugguuucgaaggcuguuuuaaaccaauuucugaacgc

SEQ ID NO: 1189 - RNA, 352 nt, artificial sequence
  synthetic construct
gcaucaauuaccggcagguuccauacaagaugauuucuuuuugcuucgugaguguacgaaccaucgcauucacccacuauuggagagcaaccaauuggcaaaggaauuguaauguuaacguccacuaauucuaaguuagugugggcaaguucguauucaauauucacaucgcaacugccgucuccugcuucagaaggccaacaguuuauuagcagaggcaccagggcuucgucaguacuuugcaaucgccauuuuaauacaccuacgucaguguggagcgggaaugguuucgaaggcuguuuuaaaccaauuucugaacgcaauuugaacaguucuuuaucgacauucgggc

SEQ ID NO: 1190 - RNA, 352 nt, artificial sequence
  synthetic construct
guguugcuagcaucaauuaccggcagguuccauacaagaugauuucuuuuugcuucgugaguguacgaaccaucgcauucacccacuauuggagagcaaccaauuggcaaaggaauuguaauguuaacguccacuaauucuaaguuagugugggcaaguucguauucaauauucacaucgcaacugccgucuccugcuucagaaggccaacaguuuauuagcagaggcaccagggcuucgucaguacuuugcaaucgccauuuuaauacaccuacgucaguguggagcgggaaugguuucgaaggcuguuuuaaaccaauuucugaacgcaauuugaacaguucuuuaucgc

SEQ ID NO: 1191 - RNA, 351 nt, artificial sequence
  synthetic construct
gcccauaugccuuugaaguguaaucaaauuaaccaguguguccggauaauuagcaucuuuaucuauagcuuccugcaaagcagcuucagcuuccucauauuuagccuguccuauaaaagcaacugcuugcccauucaacagaagaggcgucgagccauauuuaucaaccauuucuugauaaauguaguaagcaucuugcaauuuaucaccuccaauggcaacauuaacccaagcuugcgcuagcuguguuaacguggcaucaucaucuuuauccugcauuuccuugagcuucuucuuagccaaaucuacccgaucuaacuucaauaauauaucgaugaugaaagcguaagc

SEQ ID NO: 1192 - RNA, 352 nt, artificial sequence
  synthetic construct
gcugcaaagcagcuucagcuuccucauauuuagccuguccuauaaaagcaacugcuugcccauucaacagaagaggcgucgagccauauuuaucaaccauuucuugauaaauguaguaagcaucuugcaauuuaucaccuccaauggcaacauuaacccaagcuugcgcuagcuguguuaacguggcaucaucaucuuuauccugcauuuccuugagcuucuucuuagccaaaucuacccgaucuaacuucaauaauauaucgaugaugaaagcguaagcuuccagauuuuccgaagcaugaagcacuuuguaagcggcuuccaaguugccuucguuaacguaaacaguggc

SEQ ID NO: 1193 - RNA, 352 nt, artificial sequence
  synthetic construct
guuucacagcuucauccaacguauucaucgaacugagagaauacguauccuccuuuuccacggaacccucagcagccgauucccaagcggcgccccaauugaccuugcucacucucuguauuugaucgcccaacguuauuuccaagucuucgaguauguauucaucauuguaaccuucaucgcuaucgggaaugccaguggugggaucgcaaucuuuaacgauaaacuucaacaccgccccgaaaguaccaacgcaacuaggcaaaucgucgucggggaacuucaaaauagcguaggugugauuggucucguuguaaugcagcugcuugcacggcaccaccgacagcaacuc

SEQ ID NO: 1194 - RNA, 352 nt, artificial sequence
  synthetic construct
guucauccaacguauucaucgaacugagagaauacguauccuccuuuuccacggaacccucagcagccgauucccaagcggcgccccaauugaccuugcucacucucuguauuugaucgcccaacguuauuuccaagucuucgaguauguauucaucauuguaaccuucaucgcuaucgggaaugccaguggugggaucgcaaucuuuaacgauaaacuucaacaccgccccgaaaguaccaacgcaacuaggcaaaucgucgucggggaacuucaaaauagcguaggugugauuggucucguuguaaugcagcugcuugcacggcaccaccgacagcaacucgaacccuuc

SEQ ID NO: 1195 - RNA, 352 nt, artificial sequence
  synthetic construct
guuccuccucuaaagacuccugauaguagaagcgugugggugcucuugccuucgggcacuuuaucaguucuuucggccgguugcaauccaaggaacugcacgauauuuuucacagcuucauccaacguauucaucgaacugagagaauacguauccuccuuuuccacggaacccucagcagccgauucccaagcggcgccccaauugaccuugcucacucucuguauuugaucgcccaacguuauuuccaagucuucgaguauguauucaucauuguaaccuucaucgcuaucgggaaugccaguggugggaucgcaaucuuuaacgauaaacuucaacaccgccccgaaac

SEQ ID NO: 1196 - RNA, 351 nt, artificial sequence
  synthetic construct
guuaccaaaauaucgauuccuccucuaaagacuccugauaguagaagcgugugggugcucuugccuucgggcacuuuaucaguucuuucggccgguugcaauccaaggaacugcacgauauuuuucacagcuucauccaacguauucaucgaacugagagaauacguauccuccuuuuccacggaacccucagcagccgauucccaagcggcgccccaauugaccuugcucacucucuguauuugaucgcccaacguuauuuccaagucuucgaguauguauucaucauuguaaccuucaucgcuaucgggaaugccaguggugggaucgcaaucuuuaacgauaaacuuc

SEQ ID NO: 1197 - RNA, 351 nt, artificial sequence
  synthetic construct
gucgggugaucuuacagucaguugcauuguaacaccauccgcuaaagcaaguuuagcucuuaccaaaauaucgauuccuccucuaaagacuccugauaguagaagcgugugggugcucuugccuucgggcacuuuaucaguucuuucggccgguugcaauccaaggaacugcacgauauuuuucacagcuucauccaacguauucaucgaacugagagaauacguauccuccuuuuccacggaacccucagcagccgauucccaagcggcgccccaauugaccuugcucacucucuguauuugaucgcccaacguuauuuccaagucuucgaguauguauucaucauuguc

SEQ ID NO: 1198 - RNA, 350 nt, artificial sequence
  synthetic construct
ggugaucuuacagucaguugcauuguaacaccauccgcuaaagcaaguuuagcucuuaccaaaauaucgauuccuccucuaaagacuccugauaguagaagcgugugggugcucuugccuucgggcacuuuaucaguucuuucggccgguugcaauccaaggaacugcacgauauuuuucacagcuucauccaacguauucaucgaacugagagaauacguauccuccuuuuccacggaacccucagcagccgauucccaagcggcgccccaauugaccuugcucacucucuguauuugaucgcccaacguuauuuccaagucuucgaguauguauucaucauuguaacc

SEQ ID NO: 1199 - RNA, 352 nt, artificial sequence
  synthetic construct
gcaguugcauuguaacaccauccgcuaaagcaaguuuagcucuuaccaaaauaucgauuccuccucuaaagacuccugauaguagaagcgugugggugcucuugccuucgggcacuuuaucaguucuuucggccgguugcaauccaaggaacugcacgauauuuuucacagcuucauccaacguauucaucgaacugagagaauacguauccuccuuuuccacggaacccucagcagccgauucccaagcggcgccccaauugaccuugcucacucucuguauuugaucgcccaacguuauuuccaagucuucgaguauguauucaucauuguaaccuucaucgcuaucggc

SEQ ID NO: 1200 - RNA, 352 nt, artificial sequence
  synthetic construct
guaacaccauccgcuaaagcaaguuuagcucuuaccaaaauaucgauuccuccucuaaagacuccugauaguagaagcgugugggugcucuugccuucgggcacuuuaucaguucuuucggccgguugcaauccaaggaacugcacgauauuuuucacagcuucauccaacguauucaucgaacugagagaauacguauccuccuuuuccacggaacccucagcagccgauucccaagcggcgccccaauugaccuugcucacucucuguauuugaucgcccaacguuauuuccaagucuucgaguauguauucaucauuguaaccuucaucgcuaucgggaaugccagugc

SEQ ID NO: 1201 - RNA, 351 nt, artificial sequence
  synthetic construct
guauuuuucacagcuucauccaacguauucaucgaacugagagaauacguauccuccuuuuccacggaacccucagcagccgauucccaagcggcgccccaauugaccuugcucacucucuguauuugaucgcccaacguuauuuccaagucuucgaguauguauucaucauuguaaccuucaucgcuaucgggaaugccaguggugggaucgcaaucuuuaacgauaaacuucaacaccgccccgaaaguaccaacgcaacuaggcaaaucgucgucggggaacuucaaaauagcguaggugugauuggucucguuguaaugcagcugcuugcacggcaccaccgacagc

SEQ ID NO: 1202 - RNA, 351 nt, artificial sequence
  synthetic construct
gccaaaauaucgauuccuccucuaaagacuccugauaguagaagcgugugggugcucuugccuucgggcacuuuaucaguucuuucggccgguugcaauccaaggaacugcacgauauuuuucacagcuucauccaacguauucaucgaacugagagaauacguauccuccuuuuccacggaacccucagcagccgauucccaagcggcgccccaauugaccuugcucacucucuguauuugaucgcccaacguuauuuccaagucuucgaguauguauucaucauuguaaccuucaucgcuaucgggaaugccaguggugggaucgcaaucuuuaacgauaaacuucaac

SEQ ID NO: 1203 - RNA, 351 nt, artificial sequence
  synthetic construct
guucacagcuucauccaacguauucaucgaacugagagaauacguauccuccuuuuccacggaacccucagcagccgauucccaagcggcgccccaauugaccuugcucacucucuguauuugaucgcccaacguuauuuccaagucuucgaguauguauucaucauuguaaccuucaucgcuaucgggaaugccaguggugggaucgcaaucuuuaacgauaaacuucaacaccgccccgaaaguaccaacgcaacuaggcaaaucgucgucggggaacuucaaaauagcguaggugugauuggucucguuguaaugcagcugcuugcacggcaccaccgacagcaacuc

SEQ ID NO: 1204 - RNA, 351 nt, artificial sequence
  synthetic construct
guaaugaaucuaaaacuacccucuuuuccauauucuuccuuagaauuugacucacggaaucguauaagcaauuuaaaacgcucauuagaauuaacucauuuucaugagaacuacccauaacauagaaaaauaaaucuacguuacuuuuguacacacauguaaggccaucaagcauuauaauuuccgcguucgcccuguggguuuuguugaacagguuuuucucgaaagucuucugcucuuucgcugugggaaauacguuuuugucguaauacuuugccaauauucgguuuccaucauuauccaauauagcuaugccuuuaauggcguucaaaguggguuccaauaacgagc

SEQ ID NO: 1205 - RNA, 352 nt, artificial sequence
  synthetic construct
guaauaaugaccauuucagcuguucuuuggcugauugaaacaccugggcgacuguuugcuccccaaucggaaugucgucguuucuuaaagcaacucucgauaugaccgaguuggaaucggcaucgaugauaaucccuccaucacagauuucauccauggccaacaugacuauaucuaaugaaucuaaaacuacccucuuuuccauauucuuccuuagaauuugacucacggaaucguauaagcaauuuaaaacgcucauuagaauuaacucauuuucaugagaacuacccauaacauagaaaaauaaaucuacguuacuuuuguacacacauguaaggccaucaagcauuac

SEQ ID NO: 1206 - RNA, 351 nt, artificial sequence
  synthetic construct
guaucuaaugaaucuaaaacuacccucuuuuccauauucuuccuuagaauuugacucacggaaucguauaagcaauuuaaaacgcucauuagaauuaacucauuuucaugagaacuacccauaacauagaaaaauaaaucuacguuacuuuuguacacacauguaaggccaucaagcauuauaauuuccgcguucgcccuguggguuuuguugaacagguuuuucucgaaagucuucugcucuuucgcugugggaaauacguuuuugucguaauacuuugccaauauucgguuuccaucauuauccaauauagcuaugccuuuaauggcguucaaaguggguuccaauaac

SEQ ID NO: 1207 - RNA, 352 nt, artificial sequence
  synthetic construct
gacccucuuuuccauauucuuccuuagaauuugacucacggaaucguauaagcaauuuaaaacgcucauuagaauuaacucauuuucaugagaacuacccauaacauagaaaaauaaaucuacguuacuuuuguacacacauguaaggccaucaagcauuauaauuuccgcguucgcccuguggguuuuguugaacagguuuuucucgaaagucuucugcucuuucgcugugggaaauacguuuuugucguaauacuuugccaauauucgguuuccaucauuauccaauauagcuaugccuuuaauggcguucaaaguggguuccaauaacgagccuuccauuagugaauuc

SEQ ID NO: 1208 - RNA, 352 nt, artificial sequence
  synthetic construct
guaaaacuacccucuuuuccauauucuuccuuagaauuugacucacggaaucguauaagcaauuuaaaacgcucauuagaauuaacucauuuucaugagaacuacccauaacauagaaaaauaaaucuacguuacuuuuguacacacauguaaggccaucaagcauuauaauuuccgcguucgcccuguggguuuuguugaacagguuuuucucgaaagucuucugcucuuucgcugugggaaauacguuuuugucguaauacuuugccaauauucgguuuccaucauuauccaauauagcuaugccuuuaauggcguucaaaguggguuccaauaacgagccuuccauuac

SEQ ID NO: 1209 - RNA, 351 nt, artificial sequence
  synthetic construct
guuucuuaaagcaacucucgauaugaccgaguuggaaucggcaucgaugauaaucccuccaucacagauuucauccauggccaacaugacuauaucuaaugaaucuaaaacuacccucuuuuccauauucuuccuuagaauuugacucacggaaucguauaagcaauuuaaaacgcucauuagaauuaacucauuuucaugagaacuacccauaacauagaaaaauaaaucuacguuacuuuuguacacacauguaaggccaucaagcauuauaauuuccgcguucgcccuguggguuuuguugaacagguuuuucucgaaagucuucugcucuuucgcugugggaaauac

SEQ ID NO: 1210 - RNA, 352 nt, artificial sequence
  synthetic construct
guuuuaucuucucuauuaccaaagucaccaccuucaacguagugauuggucuucuugcgccacccaccaguagguguguuuagcuuaaacggccacaagaaguuagaggcguacuuaaacuuagguccaacaguaaaaauuucaugaaucaaaucuuccaugcaaauaauuccagauuugccuaaucugucuucgaugauuugauugcucguaaugggcacucucuguccguucacuuuagcgaaaccucucuuguagaucagcucccugaccgauuucaaguugggguaaccccagguaauguaagguucgcauauucuaagcauguugaugguagccuuguugagcuggc

SEQ ID NO: 1211 - RNA, 351 nt, artificial sequence
  synthetic construct
guacaccauucuucugagaaguucguuaauuuuaucuucucuauuaccaaagucaccaccuucaacguagugauuggucuucuugcgccacccaccaguagguguguuuagcuuaaacggccacaagaaguuagaggcguacuuaaacuuagguccaacaguaaaaauuucaugaaucaaaucuuccaugcaaauaauuccagauuugccuaaucugucuucgaugauuugauugcucguaaugggcacucucuguccguucacuuuagcgaaaccucucuuguagaucagcucccugaccgauuucaaguugggguaaccccagguaauguaagguucgcauauucuaac

SEQ ID NO: 1212 - RNA, 351 nt, artificial sequence
  synthetic construct
gaucugucuucgaugauuugauugcucguaaugggcacucucuguccguucacuuuagcgaaaccucucuuguagaucagcucccugaccgauuucaaguugggguaaccccagguaauguaagguucgcauauucuaagcauguugaugguagccuuguugagcuggacgaacacuccguuguugauuuggagcagccugaacaguuggaggacuuugcgaacuuucggggcaaccuuguugauacccuuaauacgcauuacgaaagcuaauuuagcuuccgcuggaacguagaaguuucccuuguuuuuagcuuggcggaucaaccuaauuucaucucguuccuucagc

SEQ ID NO: 1213 - RNA, 351 nt, artificial sequence
  synthetic construct
gagaaguucguuaauuuuaucuucucuauuaccaaagucaccaccuucaacguagugauuggucuucuugcgccacccaccaguagguguguuuagcuuaaacggccacaagaaguuagaggcguacuuaaacuuagguccaacaguaaaaauuucaugaaucaaaucuuccaugcaaauaauuccagauuugccuaaucugucuucgaugauuugauugcucguaaugggcacucucuguccguucacuuuagcgaaaccucucuuguagaucagcucccugaccgauuucaaguugggguaaccccagguaauguaagguucgcauauucuaagcauguugaugguagc

SEQ ID NO: 1214 - RNA, 352 nt, artificial sequence
  synthetic construct
guucgcauauucuaagcauguugaugguagccuuguugagcuggacgaacacuccguuguugauuuggagcagccugaacaguuggaggacuuugcgaacuuucggggcaaccuuguugauacccuuaauacgcauuacgaaagcuaauuuagcuuccgcuggaacguagaaguuucccuuguuuuuagcuuggcggaucaaccuaauuucaucucguuccuucagccuguacucuuuaauguauuguucggcccucuugaaaauaucuuuccucuucuugaugugcucggauuuucucuucacgauagauuggagccucuuagcucuggaagccucgcgccuuuugcgguc

SEQ ID NO: 1215 - RNA, 352 nt, artificial sequence
  synthetic construct
gcacuuuagcgaaaccucucuuguagaucagcucccugaccgauuucaaguugggguaaccccagguaauguaagguucgcauauucuaagcauguugaugguagccuuguugagcuggacgaacacuccguuguugauuuggagcagccugaacaguuggaggacuuugcgaacuuucggggcaaccuuguugauacccuuaauacgcauuacgaaagcuaauuuagcuuccgcuggaacguagaaguuucccuuguuuuuagcuuggcggaucaaccuaauuucaucucguuccuucagccuguacucuuuaauguauuguucggcccucuugaaaauaucuuuccucuc

SEQ ID NO: 1216 - RNA, 351 nt, artificial sequence
  synthetic construct
guuagaggcguacuuaaacuuagguccaacaguaaaaauuucaugaaucaaaucuuccaugcaaauaauuccagauuugccuaaucugucuucgaugauuugauugcucguaaugggcacucucuguccguucacuuuagcgaaaccucucuuguagaucagcucccugaccgauuucaaguugggguaaccccagguaauguaagguucgcauauucuaagcauguugaugguagccuuguugagcuggacgaacacuccguuguugauuuggagcagccugaacaguuggaggacuuugcgaacuuucggggcaaccuuguugauacccuuaauacgcauuacgaaagc

SEQ ID NO: 1217 - RNA, 352 nt, artificial sequence
  synthetic construct
gucugagaaguucguuaauuuuaucuucucuauuaccaaagucaccaccuucaacguagugauuggucuucuugcgccacccaccaguagguguguuuagcuuaaacggccacaagaaguuagaggcguacuuaaacuuagguccaacaguaaaaauuucaugaaucaaaucuuccaugcaaauaauuccagauuugccuaaucugucuucgaugauuugauugcucguaaugggcacucucuguccguucacuuuagcgaaaccucucuuguagaucagcucccugaccgauuucaaguugggguaaccccagguaauguaagguucgcauauucuaagcauguugauggc

SEQ ID NO: 1218 - RNA, 352 nt, artificial sequence
  synthetic construct
gaccucucuuguagaucagcucccugaccgauuucaaguugggguaaccccagguaauguaagguucgcauauucuaagcauguugaugguagccuuguugagcuggacgaacacuccguuguugauuuggagcagccugaacaguuggaggacuuugcgaacuuucggggcaaccuuguugauacccuuaauacgcauuacgaaagcuaauuuagcuuccgcuggaacguagaaguuucccuuguuuuuagcuuggcggaucaaccuaauuucaucucguuccuucagccuguacucuuuaauguauuguucggcccucuugaaaauaucuuuccucuucuugaugugcuc

SEQ ID NO: 1219 - RNA, 352 nt, artificial sequence
  synthetic construct
guaucaucaucaucuucagccauuuccuuggccaauuccaaauccugcugcucccucucccgucuuuccucagccgauuccaguuccuuuccguacgcauucggcggguaucucauggcuuucacgcucugauugugcaaauccaaacaaaaugauauccucugaugaaaggccaauugaggcucuuuaguacaguagauaucaguacucucuuuacuccucauguagcccccuuguggguccaaaguagcuucgauaacaccaucucgaauggccuucgcuacgaugaauuccgcauccuccgcugaauccaggcccaauuucuuagcuauauccugcggagauauccugc

SEQ ID NO: 1220 - RNA, 351 nt, artificial sequence
  synthetic construct
guaucucauggcuuucacgcucugauugugcaaauccaaacaaaaugauauccucugaugaaaggccaauugaggcucuuuaguacaguagauaucaguacucucuuuacuccucauguagcccccuuguggguccaaaguagcuucgauaacaccaucucgaauggccuucgcuacgaugaauuccgcauccuccgcugaauccaggcccaauuucuuagcuauauccugcggagauauccuggaauaagacaaaccaaucgaucuaauagcugucuugauaacauuaugccgaagccgcaggaucaaaguaaacguaugaucuacccuaaauugcggcccaaaauucuc

SEQ ID NO: 1221 - RNA, 352 nt, artificial sequence
  synthetic construct
gugauugugcaaauccaaacaaaaugauauccucugaugaaaggccaauugaggcucuuuaguacaguagauaucaguacucucuuuacuccucauguagcccccuuguggguccaaaguagcuucgauaacaccaucucgaauggccuucgcuacgaugaauuccgcauccuccgcugaauccaggcccaauuucuuagcuauauccugcggagauauccuggaauaagacaaaccaaucgaucuaauagcugucuugauaacauuaugccgaagccgcaggaucaaaguaaacguaugaucuacccuaaauugcggcccaaaauucuccaacaccuccccgaaccguugc

SEQ ID NO: 1222 - RNA, 352 nt, artificial sequence
  synthetic construct
gaucaucaucaucuucagccauuuccuuggccaauuccaaauccugcugcucccucucccgucuuuccucagccgauuccaguuccuuuccguacgcauucggcggguaucucauggcuuucacgcucugauugugcaaauccaaacaaaaugauauccucugaugaaaggccaauugaggcucuuuaguacaguagauaucaguacucucuuuacuccucauguagcccccuuguggguccaaaguagcuucgauaacaccaucucgaauggccuucgcuacgaugaauuccgcauccuccgcugaauccaggcccaauuucuuagcuauauccugcggagauauccuggc

SEQ ID NO: 1223 - RNA, 351 nt, artificial sequence
  synthetic construct
gaacuaucaucaucaucuucagccauuuccuuggccaauuccaaauccugcugcucccucucccgucuuuccucagccgauuccaguuccuuuccguacgcauucggcggguaucucauggcuuucacgcucugauugugcaaauccaaacaaaaugauauccucugaugaaaggccaauugaggcucuuuaguacaguagauaucaguacucucuuuacuccucauguagcccccuuguggguccaaaguagcuucgauaacaccaucucgaauggccuucgcuacgaugaauuccgcauccuccgcugaauccaggcccaauuucuuagcuauauccugcggagauauc

SEQ ID NO: 1224 - RNA, 350 nt, artificial sequence
  synthetic construct
gcaacaaauugaaaauauccugcaauugauagaugaucugaugauugaugggcaguuuguuaucgcacacuugcaucaaauagucucuuauaucucucaauugcaaaugcaacccuuuaaggccuaauaacugauuaguaauccuuugagauaaaguucccacuguagugucuuuaauaucucuuaguaaauguucuacuccgacuuccucagcuucuucugcgccuauuucgcucgggacguguucaaacguuuuagauguaggagagccaucaucauggaccucuucuaccgcuugguaugcuucaguaggaagccccagaucuuuagguuucgcaucuauaaucacc

SEQ ID NO: 1225 - RNA, 351 nt, artificial sequence
  synthetic construct
gucuucugcgucucuguuggugaguuuguuguugauuagguugugcaaugcaacgauagaucgaacgagagccccuaaauaaacuacaagcauuugaucguuauuuuuaacauaaaacgaauuguugaacgcaucuugauuuauaucgggcaacaaauugaaaauauccugcaauugauagaugaucugaugauugaugggcaguuuguuaucgcacacuugcaucaaauagucucuuauaucucucaauugcaaaugcaacccuuuaaggccuaauaacugauuaguaauccuuugagauaaaguucccacuguagugucuuuaauaucucuuaguaaauguucuacucc

SEQ ID NO: 1226 - RNA, 351 nt, artificial sequence
  synthetic construct
guauuuuuucuucucguccuucuucgcuuccuucucuuuguccguuuuuuccuuauccuugucuuugcuaucuuuauccuuguuguccuuuuucucuuccuuuuugccuucuucugcgucucuguuggugaguuuguuguugauuagguugugcaaugcaacgauagaucgaacgagagccccuaaauaaacuacaagcauuugaucguuauuuuuaacauaaaacgaauuguugaacgcaucuugauuuauaucgggcaacaaauugaaaauauccugcaauugauagaugaucugaugauugaugggcaguuuguuaucgcacacuugcaucaaauagucucuuauauc

SEQ ID NO: 1227 - RNA, 352 nt, artificial sequence
  synthetic construct
guuucuucucguccuucuucgcuuccuucucuuuguccguuuuuuccuuauccuugucuuugcuaucuuuauccuuguuguccuuuuucucuuccuuuuugccuucuucugcgucucuguuggugaguuuguuguugauuagguugugcaaugcaacgauagaucgaacgagagccccuaaauaaacuacaagcauuugaucguuauuuuuaacauaaaacgaauuguugaacgcaucuugauuuauaucgggcaacaaauugaaaauauccugcaauugauagaugaucugaugauugaugggcaguuuguuaucgcacacuugcaucaaauagucucuuauaucucucac

SEQ ID NO: 1228 - RNA, 352 nt, artificial sequence
  synthetic construct
guauccuugucuuugcuaucuuuauccuuguuguccuuuuucucuuccuuuuugccuucuucugcgucucuguuggugaguuuguuguugauuagguugugcaaugcaacgauagaucgaacgagagccccuaaauaaacuacaagcauuugaucguuauuuuuaacauaaaacgaauuguugaacgcaucuugauuuauaucgggcaacaaauugaaaauauccugcaauugauagaugaucugaugauugaugggcaguuuguuaucgcacacuugcaucaaauagucucuuauaucucucaauugcaaaugcaacccuuuaaggccuaauaacugauuaguaauccuuc

SEQ ID NO: 1229 - RNA, 351 nt, artificial sequence
  synthetic construct
guuuuucucuuccuuuuugccuucuucugcgucucuguuggugaguuuguuguugauuagguugugcaaugcaacgauagaucgaacgagagccccuaaauaaacuacaagcauuugaucguuauuuuuaacauaaaacgaauuguugaacgcaucuugauuuauaucgggcaacaaauugaaaauauccugcaauugauagaugaucugaugauugaugggcaguuuguuaucgcacacuugcaucaaauagucucuuauaucucucaauugcaaaugcaacccuuuaaggccuaauaacugauuaguaauccuuugagauaaaguucccacuguagugucuuuaauauc

SEQ ID NO: 1230 - RNA, 352 nt, artificial sequence
  synthetic construct
guucuucucguccuucuucgcuuccuucucuuuguccguuuuuuccuuauccuugucuuugcuaucuuuauccuuguuguccuuuuucucuuccuuuuugccuucuucugcgucucuguuggugaguuuguuguugauuagguugugcaaugcaacgauagaucgaacgagagccccuaaauaaacuacaagcauuugaucguuauuuuuaacauaaaacgaauuguugaacgcaucuugauuuauaucgggcaacaaauugaaaauauccugcaauugauagaugaucugaugauugaugggcaguuuguuaucgcacacuugcaucaaauagucucuuauaucucucaac

SEQ ID NO: 1231 - RNA, 351 nt, artificial sequence
  synthetic construct
guaucuuuauccuuguuguccuuuuucucuuccuuuuugccuucuucugcgucucuguuggugaguuuguuguugauuagguugugcaaugcaacgauagaucgaacgagagccccuaaauaaacuacaagcauuugaucguuauuuuuaacauaaaacgaauuguugaacgcaucuugauuuauaucgggcaacaaauugaaaauauccugcaauugauagaugaucugaugauugaugggcaguuuguuaucgcacacuugcaucaaauagucucuuauaucucucaauugcaaaugcaacccuuuaaggccuaauaacugauuaguaauccuuugagauaaaguuccc

SEQ ID NO: 1232 - RNA, 352 nt, artificial sequence
  synthetic construct
guuugcuaucuuuauccuuguuguccuuuuucucuuccuuuuugccuucuucugcgucucuguuggugaguuuguuguugauuagguugugcaaugcaacgauagaucgaacgagagccccuaaauaaacuacaagcauuugaucguuauuuuuaacauaaaacgaauuguugaacgcaucuugauuuauaucgggcaacaaauugaaaauauccugcaauugauagaugaucugaugauugaugggcaguuuguuaucgcacacuugcaucaaauagucucuuauaucucucaauugcaaaugcaacccuuuaaggccuaauaacugauuaguaauccuuugagauaaagc

SEQ ID NO: 1233 - RNA, 351 nt, artificial sequence
  synthetic construct
gccuuauccuugucuuugcuaucuuuauccuuguuguccuuuuucucuuccuuuuugccuucuucugcgucucuguuggugaguuuguuguugauuagguugugcaaugcaacgauagaucgaacgagagccccuaaauaaacuacaagcauuugaucguuauuuuuaacauaaaacgaauuguugaacgcaucuugauuuauaucgggcaacaaauugaaaauauccugcaauugauagaugaucugaugauugaugggcaguuuguuaucgcacacuugcaucaaauagucucuuauaucucucaauugcaaaugcaacccuuuaaggccuaauaacugauuaguaauc

SEQ ID NO: 1234 - RNA, 351 nt, artificial sequence
  synthetic construct
gacuuugcacaaguuuugggcauccggguugauuuuuacuuuggguucagucuuuucuaggaaagcgaucgcgucuuucgguuccuuguacuguucgacgacaauggccgcuauuucgaccaaagacaaaggauuaauuuuauuuucaaacguuugaauaaaauugugguacagcuggauuagguuguccgcuuucuguaauucugguuucuuuauaaacacuaguaauuugaggguuaguugaugccauaauuuuuuauuauggagcuccucaaguucugcccacucagagcccaauuccuucggacuuucuuuuuguuguuuagcaagauaaucacuaacauuagacgc

SEQ ID NO: 1235 - RNA, 352 nt, artificial sequence
  synthetic construct
gaauaaaaucucccguguacuggaguaaccccguccgcauuaucaaaggucgcuucgaccuccucgaugaucuuuuugguggugucuaaaucguuuaacuuaucaagguagaucuguccuucgaggacuuugcacaaguuuugggcauccggguugauuuuuacuuuggguucagucuuuucuaggaaagcgaucgcgucuuucgguuccuuguacuguucgacgacaauggccgcuauuucgaccaaagacaaaggauuaauuuuauuuucaaacguuugaauaaaauugugguacagcuggauuagguuguccgcuuucuguaauucugguuucuuuauaaacacuaguc

SEQ ID NO: 1236 - RNA, 351 nt, artificial sequence
  synthetic construct
gauugcgaggcgaguaaauaaaaucucccguguacuggaguaaccccguccgcauuaucaaaggucgcuucgaccuccucgaugaucuuuuugguggugucuaaaucguuuaacuuaucaagguagaucuguccuucgaggacuuugcacaaguuuugggcauccggguugauuuuuacuuuggguucagucuuuucuaggaaagcgaucgcgucuuucgguuccuuguacuguucgacgacaauggccgcuauuucgaccaaagacaaaggauuaauuuuauuuucaaacguuugaauaaaauugugguacagcuggauuagguuguccgcuuucuguaauucugguuuc

SEQ ID NO: 1237 - RNA, 351 nt, artificial sequence
  synthetic construct
gaacgauuccacaucuaugcagcccaaauaccucaaagcagugcgauaauauugcgcauggucuccuugaauucuguaauauugcgaggcgaguaaauaaaaucucccguguacuggaguaaccccguccgcauuaucaaaggucgcuucgaccuccucgaugaucuuuuugguggugucuaaaucguuuaacuuaucaagguagaucuguccuucgaggacuuugcacaaguuuugggcauccggguugauuuuuacuuuggguucagucuuuucuaggaaagcgaucgcgucuuucgguuccuuguacuguucgacgacaauggccgcuauuucgaccaaagacaaagc

SEQ ID NO: 1238 - RNA, 350 nt, artificial sequence
  synthetic construct
ggacuuugcacaaguuuugggcauccggguugauuuuuacuuuggguucagucuuuucuaggaaagcgaucgcgucuuucgguuccuuguacuguucgacgacaauggccgcuauuucgaccaaagacaaaggauuaauuuuauuuucaaacguuugaauaaaauugugguacagcuggauuagguuguccgcuuucuguaauucugguuucuuuauaaacacuaguaauuugaggguuaguugaugccauaauuuuuuauuauggagcuccucaaguucugcccacucagagcccaauuccuucggacuuucuuuuuguuguuuagcaagauaaucacuaacauuagac

SEQ ID NO: 1239 - RNA, 352 nt, artificial sequence
  synthetic construct
gacuuugcacaaguuuugggcauccggguugauuuuuacuuuggguucagucuuuucuaggaaagcgaucgcgucuuucgguuccuuguacuguucgacgacaauggccgcuauuucgaccaaagacaaaggauuaauuuuauuuucaaacguuugaauaaaauugugguacagcuggauuagguuguccgcuuucuguaauucugguuucuuuauaaacacuaguaauuugaggguuaguugaugccauaauuuuuuauuauggagcuccucaaguucugcccacucagagcccaauuccuucggacuuucuuuuuguuguuuagcaagauaaucacuaacauuagacggc

SEQ ID NO: 1240 - RNA, 352 nt, artificial sequence
  synthetic construct
guuuugguggugucuaaaucguuuaacuuaucaagguagaucuguccuucgaggacuuugcacaaguuuugggcauccggguugauuuuuacuuuggguucagucuuuucuaggaaagcgaucgcgucuuucgguuccuuguacuguucgacgacaauggccgcuauuucgaccaaagacaaaggauuaauuuuauuuucaaacguuugaauaaaauugugguacagcuggauuagguuguccgcuuucuguaauucugguuucuuuauaaacacuaguaauuugaggguuaguugaugccauaauuuuuuauuauggagcuccucaaguucugcccacucagagcccaauc

SEQ ID NO: 1241 - RNA, 352 nt, artificial sequence
  synthetic construct
gaacgauuccacaucuaugcagcccaaauaccucaaagcagugcgauaauauugcgcauggucuccuugaauucuguaauauugcgaggcgaguaaauaaaaucucccguguacuggaguaaccccguccgcauuaucaaaggucgcuucgaccuccucgaugaucuuuuugguggugucuaaaucguuuaacuuaucaagguagaucuguccuucgaggacuuugcacaaguuuugggcauccggguugauuuuuacuuuggguucagucuuuucuaggaaagcgaucgcgucuuucgguuccuuguacuguucgacgacaauggccgcuauuucgaccaaagacaaaggc

SEQ ID NO: 1242 - RNA, 352 nt, artificial sequence
  synthetic construct
gaucguuuaacuuaucaagguagaucuguccuucgaggacuuugcacaaguuuugggcauccggguugauuuuuacuuuggguucagucuuuucuaggaaagcgaucgcgucuuucgguuccuuguacuguucgacgacaauggccgcuauuucgaccaaagacaaaggauuaauuuuauuuucaaacguuugaauaaaauugugguacagcuggauuagguuguccgcuuucuguaauucugguuucuuuauaaacacuaguaauuugaggguuaguugaugccauaauuuuuuauuauggagcuccucaaguucugcccacucagagcccaauuccuucggacuuucuuc

SEQ ID NO: 1243 - RNA, 351 nt, artificial sequence
  synthetic construct
gucaacagcgcgucgagcucccguuugcuuucuccgaaucgagaucuaucguuagcgucgauaaggaauacaauggcgucuacggcugggaaguaguccuuccauacucuucgagccugcgaauggccuccuagaucgaacgugguaaaccucauguucccgauggacaguucuucagaagugggauguaacgugggcaagugcugggcuaaucuaucgucuuuaagcauguguaauaaggugguuuuaccagcguuauccagcccuaaaaacagcaauuucccggacuucuuccauaauccuagguagcccagcacucccgugaaccaaucccauaugaacauuucgguc

SEQ ID NO: 1244 - RNA, 352 nt, artificial sequence
  synthetic construct
guuuauugccuagaaucagcacggggcaguuggccaggguuucgucugucaacagcgcgucgagcucccguuugcuuucuccgaaucgagaucuaucguuagcgucgauaaggaauacaauggcgucuacggcugggaaguaguccuuccauacucuucgagccugcgaauggccuccuagaucgaacgugguaaaccucauguucccgauggacaguucuucagaagugggauguaacgugggcaagugcugggcuaaucuaucgucuuuaagcauguguaauaaggugguuuuaccagcguuauccagcccuaaaaacagcaauuucccggacuucuuccauaauccuac

SEQ ID NO: 1245 - RNA, 350 nt, artificial sequence
  synthetic construct
guaaucaauguacugcgccagccaacgaaaacccuccccguagcccugccucuucagaaucgagcacauaaacagcuccaacggucuccccggcagauccgaucgagcgacuuuaccuuuaccggucguuuggccguacaacgaguaaacguuucucaacucauccucagacgccgcgucggguaaaucgauuuuauugccuagaaucagcacggggcaguuggccaggguuucgucugucaacagcgcgucgagcucccguuugcuuucuccgaaucgagaucuaucguuagcgucgauaaggaauacaauggcgucuacggcugggaaguaguccuuccauacucuuc

SEQ ID NO: 1246 - RNA, 351 nt, artificial sequence
  synthetic construct
guucucaacucauccucagacgccgcgucggguaaaucgauuuuauugccuagaaucagcacggggcaguuggccaggguuucgucugucaacagcgcgucgagcucccguuugcuuucuccgaaucgagaucuaucguuagcgucgauaaggaauacaauggcgucuacggcugggaaguaguccuuccauacucuucgagccugcgaauggccuccuagaucgaacgugguaaaccucauguucccgauggacaguucuucagaagugggauguaacgugggcaagugcugggcuaaucuaucgucuuuaagcauguguaauaaggugguuuuaccagcguuauccagc

SEQ ID NO: 1247 - RNA, 352 nt, artificial sequence
  synthetic construct
guuucucaacucauccucagacgccgcgucggguaaaucgauuuuauugccuagaaucagcacggggcaguuggccaggguuucgucugucaacagcgcgucgagcucccguuugcuuucuccgaaucgagaucuaucguuagcgucgauaaggaauacaauggcgucuacggcugggaaguaguccuuccauacucuucgagccugcgaauggccuccuagaucgaacgugguaaaccucauguucccgauggacaguucuucagaagugggauguaacgugggcaagugcugggcuaaucuaucgucuuuaagcauguguaauaaggugguuuuaccagcguuauccagc

SEQ ID NO: 1248 - RNA, 352 nt, artificial sequence
  synthetic construct
guauugccuagaaucagcacggggcaguuggccaggguuucgucugucaacagcgcgucgagcucccguuugcuuucuccgaaucgagaucuaucguuagcgucgauaaggaauacaauggcgucuacggcugggaaguaguccuuccauacucuucgagccugcgaauggccuccuagaucgaacgugguaaaccucauguucccgauggacaguucuucagaagugggauguaacgugggcaagugcugggcuaaucuaucgucuuuaagcauguguaauaaggugguuuuaccagcguuauccagcccuaaaaacagcaauuucccggacuucuuccauaauccuaggc

SEQ ID NO: 1249 - RNA, 352 nt, artificial sequence
  synthetic construct
guucucucaauaguaggaucguucgccaaauucaagaacaaacaaacguucuccaucgaaccguucucuucgaaaucuuguuugaagaaacgagcaguuuccauguugacucccauagcggcgaacacgauggcgaaguugucuucgugaucguccaaagccgacuugccgggcaccuugacaagaccggcuugucuacaaauuugggcggcgauuucguuguggggcagaccagccgccgagaaaaugggaaucuucugaccacgagcgaucgaguucaucacaucgauggcggagauaccgguuuggaucauuuccuccggguagauacgcgaccaaggauugaucgguc

SEQ ID NO: 1250 - RNA, 352 nt, artificial sequence
  synthetic construct
gagcugacggucgacguagaucuguccuucgguaauauaaccggucaaaucgggaaucgggugaguaauaucgucguugggcauagucaagauggggauuugggugauggagccguugcggcccuccacacguccggcucguucguaaaugguggccaaaucgguguacauguaaccggggaaaccacgucuaccgggcacuucuucccuggcggcggauaccucacgcaaagcuucagcguacgaagacauaucagucaauaugaccaagacguguuucucgcauugauaggccaaaaauucggcugcuguuagagccaaacgaggcgugaugauucucucaauaguaggc

SEQ ID NO: 1251 - RNA, 352 nt, artificial sequence
  synthetic construct
gaauauaaccggucaaaucgggaaucgggugaguaauaucgucguugggcauagucaagauggggauuugggugauggagccguugcggcccuccacacguccggcucguucguaaaugguggccaaaucgguguacauguaaccggggaaaccacgucuaccgggcacuucuucccuggcggcggauaccucacgcaaagcuucagcguacgaagacauaucagucaauaugaccaagacguguuucucgcauugauaggccaaaaauucggcugcuguuagagccaaacgaggcgugaugauucucucaauaguaggaucguucgccaaauucaagaacaaacaaacguc

SEQ ID NO: 1252 - RNA, 350 nt, artificial sequence
  synthetic construct
ggcguucugagaaugucgccggugaauucacacacgguguuuuuggcgucgauucccgaaguaccuucgaacacuuguacuacggcuuucgagccgcucaccuccaauacuugaccggaucguagacugccaucggccaguuugagcuggacgauuucguugaauuucggaaauuugacaucuucgaggauuaccaacgguccguugacaccagacacuguuuuguaagugagccuuggcugggauacgaagucucuggacacggcuaaaacguguuccugugcggccuguuuugcguuuaacgucgauggguaagacaucuucucugcgugaagaaagauacgucuaac

SEQ ID NO: 1253 - RNA, 352 nt, artificial sequence
  synthetic construct
guagaaacgucagagugaucuuuccuggucauucccucgccgauggcggacuucaugagacgagacagugaugguaagacguuaaucgggggguaaauuugccuguugugcagcugacggucgacguagaucuguccuucgguaauauaaccggucaaaucgggaaucgggugaguaauaucgucguugggcauagucaagauggggauuugggugauggagccguugcggcccuccacacguccggcucguucguaaaugguggccaaaucgguguacauguaaccggggaaaccacgucuaccgggcacuucuucccuggcggcggauaccucacgcaaagcuucagcgc

SEQ ID NO: 1254 - RNA, 352 nt, artificial sequence
  synthetic construct
guuucucgcauugauaggccaaaaauucggcugcuguuagagccaaacgaggcgugaugauucucucaauaguaggaucguucgccaaauucaagaacaaacaaacguucuccaucgaaccguucucuucgaaaucuuguuugaagaaacgagcaguuuccauguugacucccauagcggcgaacacgauggcgaaguugucuucgugaucguccaaagccgacuugccgggcaccuugacaagaccggcuugucuacaaauuugggcggcgauuucguuguggggcagaccagccgccgagaaaaugggaaucuucugaccacgagcgaucgaguucaucacaucgauggc

SEQ ID NO: 1255 - RNA, 352 nt, artificial sequence
  synthetic construct
guucgaacacuguacgauucucguagcugcccugcgagaugaaguucuucucgaacuuggucaggaacuccagguagagcaaaucgucgggcgucagggccuccucucccaccacggccuucaucgccugaacguccuuaccaauggcguagcaagcguacaacugguuagaaacgucagagugaucuuuccuggucauucccucgccgauggcggacuucaugagacgagacagugaugguaagacguuaaucgggggguaaauuugccuguugugcagcugacggucgacguagaucuguccuucgguaauauaaccggucaaaucgggaaucgggugaguaauaucguc

SEQ ID NO: 1256 - RNA, 350 nt, artificial sequence
  synthetic construct
guaauauaaccggucaaaucgggaaucgggugaguaauaucgucguugggcauagucaagauggggauuugggugauggagccguugcggcccuccacacguccggcucguucguaaaugguggccaaaucgguguacauguaaccggggaaaccacgucuaccgggcacuucuucccuggcggcggauaccucacgcaaagcuucagcguacgaagacauaucagucaauaugaccaagacguguuucucgcauugauaggccaaaaauucggcugcuguuagagccaaacgaggcgugaugauucucucaauaguaggaucguucgccaaauucaagaacaaacaaac

SEQ ID NO: 1257 - RNA, 352 nt, artificial sequence
  synthetic construct
gcagcugacggucgacguagaucuguccuucgguaauauaaccggucaaaucgggaaucgggugaguaauaucgucguugggcauagucaagauggggauuugggugauggagccguugcggcccuccacacguccggcucguucguaaaugguggccaaaucgguguacauguaaccggggaaaccacgucuaccgggcacuucuucccuggcggcggauaccucacgcaaagcuucagcguacgaagacauaucagucaauaugaccaagacguguuucucgcauugauaggccaaaaauucggcugcuguuagagccaaacgaggcgugaugauucucucaauaguagc

SEQ ID NO: 1258 - RNA, 352 nt, artificial sequence
  synthetic construct
gcuguucaugcucugcauggcuuuggugacaccuuucauggcuugcgccauggcguucugcgaucugagcguuuggauuuuuagcgagacugcuuggauguuggcuuucauuagcaugaauuucuuuacguaucgucugguccugaccaaguccuuggccaugaucuugacggcguccauuugaccuucuuuggcuaauuuuuuaaugucguuuauaaccuucuucucuuguuguuccauuuuuuguuuuucccugucuagaucucgcauggcuuuguuuagcgcucuuugauuuuuucgaagcaauucuucgggggugacuuuuuuaccgaacagccacuccauuuuuaac

SEQ ID NO: 1259 - RNA, 352 nt, artificial sequence
  synthetic construct
guuuaucuaucucaguuugcgccgcuuccuccaucuccucagaguccucgagauccuccauggucucguccagcaucuccucgaugauaccggcuuucaucaucucuuuggacaugucuugcaucgucugcgccaccuccggcacccguacgagccucugcauggucugcaugaccuccguggauuuuugcagcgagcccgacacccugagaguggcuaauugguuuuucauuugcaacauuacggaauugaggugggcuuuggacguguagaucuuguugauggcuuugcgagaguuuaugauuucuuuggcgaguauuaggcagguguccuugucguuuuucuuggcugc

SEQ ID NO: 1260 - RNA, 352 nt, artificial sequence
  synthetic construct
guaucuaucucaguuugcgccgcuuccuccaucuccucagaguccucgagauccuccauggucucguccagcaucuccucgaugauaccggcuuucaucaucucuuuggacaugucuugcaucgucugcgccaccuccggcacccguacgagccucugcauggucugcaugaccuccguggauuuuugcagcgagcccgacacccugagaguggcuaauugguuuuucauuugcaacauuacggaauugaggugggcuuuggacguguagaucuuguugauggcuuugcgagaguuuaugauuucuuuggcgaguauuaggcagguguccuugucguuuuucuuggcugcuc

SEQ ID NO: 1261 - RNA, 352 nt, artificial sequence
  synthetic construct
guuucaucaucucuuuggacaugucuugcaucgucugcgccaccuccggcacccguacgagccucugcauggucugcaugaccuccguggauuuuugcagcgagcccgacacccugagaguggcuaauugguuuuucauuugcaacauuacggaauugaggugggcuuuggacguguagaucuuguugauggcuuugcgagaguuuaugauuucuuuggcgaguauuaggcagguguccuugucguuuuucuuggcugcuuccuuuagggaucgcuugacuuuuucuuccucucgcuguauggaucguauuugccuuuccaguugguagccuucuuugcgcaguuugugguc

SEQ ID NO: 1262 - RNA, 351 nt, artificial sequence
  synthetic construct
gacaugucuugcaucgucugcgccaccuccggcacccguacgagccucugcauggucugcaugaccuccguggauuuuugcagcgagcccgacacccugagaguggcuaauugguuuuucauuugcaacauuacggaauugaggugggcuuuggacguguagaucuuguugauggcuuugcgagaguuuaugauuucuuuggcgaguauuaggcagguguccuugucguuuuucuuggcugcuuccuuuagggaucgcuugacuuuuucuuccucucgcuguauggaucguauuugccuuuccaguugguagccuucuuugcgcaguuugugguuccacucuguaaccaac

SEQ ID NO: 1263 - RNA, 352 nt, artificial sequence
  synthetic construct
gaaucuccucuucguucuccuccuccucgggcuccuccaccgacgucgccggcaccggagacaccuucucggcgggcuccugcggcggcauuggagccuccccaaucuucccuuccguuaucucgaauagcacuuuaucuaucucaguuugcgccgcuuccuccaucuccucagaguccucgagauccuccauggucucguccagcaucuccucgaugauaccggcuuucaucaucucuuuggacaugucuugcaucgucugcgccaccuccggcacccguacgagccucugcauggucugcaugaccuccguggauuuuugcagcgagcccgacacccugagaguggcuac

SEQ ID NO: 1264 - RNA, 351 nt, artificial sequence
  synthetic construct
guuaucuaucucaguuugcgccgcuuccuccaucuccucagaguccucgagauccuccauggucucguccagcaucuccucgaugauaccggcuuucaucaucucuuuggacaugucuugcaucgucugcgccaccuccggcacccguacgagccucugcauggucugcaugaccuccguggauuuuugcagcgagcccgacacccugagaguggcuaauugguuuuucauuugcaacauuacggaauugaggugggcuuuggacguguagaucuuguugauggcuuugcgagaguuuaugauuucuuuggcgaguauuaggcagguguccuugucguuuuucuuggcugc

SEQ ID NO: 1265 - RNA, 352 nt, artificial sequence
  synthetic construct
guucaucaucucuuuggacaugucuugcaucgucugcgccaccuccggcacccguacgagccucugcauggucugcaugaccuccguggauuuuugcagcgagcccgacacccugagaguggcuaauugguuuuucauuugcaacauuacggaauugaggugggcuuuggacguguagaucuuguugauggcuuugcgagaguuuaugauuucuuuggcgaguauuaggcagguguccuugucguuuuucuuggcugcuuccuuuagggaucgcuugacuuuuucuuccucucgcuguauggaucguauuugccuuuccaguugguagccuucuuugcgcaguuugugguuc

SEQ ID NO: 1266 - RNA, 352 nt, artificial sequence
  synthetic construct
guuucccuuaucaucuuuaauaguaauaggucugucuucuuuaauucuuucuagggcagccgggcaaucaagccuauauuucuuaacaaaagcaucaacaguaggaaacucaucuccauuaacuugucugaaugcugcuuuguauugaacuaguagcuuacuacaagcaccaguauauucuuuggcaacaacacaaucccuaauguacgccuuuucaagcuguugcaauguguugauaacugcguagagaucugcuaaauuaucguauuuuucccuuucccuugcauugugauauaguuuuacuucuucguaaagcucuggacgauuuucgugauuagcagacauuauaaac

SEQ ID NO: 1267 - RNA, 351 nt, artificial sequence
  synthetic construct
gauagggacacaauaucagcaauacaucuacuaguauuucccuuaucaucuuuaauaguaauaggucugucuucuuuaauucuuucuagggcagccgggcaaucaagccuauauuucuuaacaaaagcaucaacaguaggaaacucaucuccauuaacuugucugaaugcugcuuuguauugaacuaguagcuuacuacaagcaccaguauauucuuuggcaacaacacaaucccuaauguacgccuuuucaagcuguugcaauguguugauaacugcguagagaucugcuaaauuaucguauuuuucccuuucccuugcauugugauauaguuuuacuucuucguaaagc

SEQ ID NO: 1268 - RNA, 352 nt, artificial sequence
  synthetic construct
guacaucuacuaguauuucccuuaucaucuuuaauaguaauaggucugucuucuuuaauucuuucuagggcagccgggcaaucaagccuauauuucuuaacaaaagcaucaacaguaggaaacucaucuccauuaacuugucugaaugcugcuuuguauugaacuaguagcuuacuacaagcaccaguauauucuuuggcaacaacacaaucccuaauguacgccuuuucaagcuguugcaauguguugauaacugcguagagaucugcuaaauuaucguauuuuucccuuucccuugcauugugauauaguuuuacuucuucguaaagcucuggacgauuuucgugauuac

SEQ ID NO: 1269 - RNA, 351 nt, artificial sequence
  synthetic construct
gagggacacaauaucagcaauacaucuacuaguauuucccuuaucaucuuuaauaguaauaggucugucuucuuuaauucuuucuagggcagccgggcaaucaagccuauauuucuuaacaaaagcaucaacaguaggaaacucaucuccauuaacuugucugaaugcugcuuuguauugaacuaguagcuuacuacaagcaccaguauauucuuuggcaacaacacaaucccuaauguacgccuuuucaagcuguugcaauguguugauaacugcguagagaucugcuaaauuaucguauuuuucccuuucccuugcauugugauauaguuuuacuucuucguaaagcuc

SEQ ID NO: 1270 - RNA, 352 nt, artificial sequence
  synthetic construct
guaucuaaucucaauuuguccauuacaguaaugaauagggacacaauaucagcaauacaucuacuaguauuucccuuaucaucuuuaauaguaauaggucugucuucuuuaauucuuucuagggcagccgggcaaucaagccuauauuucuuaacaaaagcaucaacaguaggaaacucaucuccauuaacuugucugaaugcugcuuuguauugaacuaguagcuuacuacaagcaccaguauauucuuuggcaacaacacaaucccuaauguacgccuuuucaagcuguugcaauguguugauaacugcguagagaucugcuaaauuaucguauuuuucccuuucccuuc

SEQ ID NO: 1271 - RNA, 352 nt, artificial sequence
  synthetic construct
guaucagcaauacaucuacuaguauuucccuuaucaucuuuaauaguaauaggucugucuucuuuaauucuuucuagggcagccgggcaaucaagccuauauuucuuaacaaaagcaucaacaguaggaaacucaucuccauuaacuugucugaaugcugcuuuguauugaacuaguagcuuacuacaagcaccaguauauucuuuggcaacaacacaaucccuaauguacgccuuuucaagcuguugcaauguguugauaacugcguagagaucugcuaaauuaucguauuuuucccuuucccuugcauugugauauaguuuuacuucuucguaaagcucuggacgauuuc

SEQ ID NO: 1272 - RNA, 351 nt, artificial sequence
  synthetic construct
guuaaaaugcguggcuguuugcacuuuacguacaggcugcaugagagcaucucgaacaacuauacuuauaucugcacccgaauacccuucugucuugcuggcuaauucuuuaauguccucuucggucaauuccguucugguauuacccaaaugcaguuuaaacauuacagcccuggccggcuccuccggcagcgguauguaaauucucuuuucgaaacgucuucgaaucgcagaaucuaauacccacgguauauucguugcuccuaguaccagaaucccuucggugucgugacccacaccuugcauuuggaccaaaaacucgguuuugauccuucuagcagacucagauuc

SEQ ID NO: 1273 - RNA, 351 nt, artificial sequence
  synthetic construct
gugcuggcuaauucuuuaauguccucuucggucaauuccguucugguauuacccaaaugcaguuuaaacauuacagcccuggccggcuccuccggcagcgguauguaaauucucuuuucgaaacgucuucgaaucgcagaaucuaauacccacgguauauucguugcuccuaguaccagaaucccuucggugucgugacccacaccuugcauuuggaccaaaaacucgguuuugauccuucuagcagacucagauucguuaucggaacgugaagaacagagcgaaucgaucucaucgaugaagaugaugcugggcuugugcgcucgggccaauucgaacagauucuucacc

SEQ ID NO: 1274 - RNA, 352 nt, artificial sequence
  synthetic construct
guauacuuauaucugcacccgaauacccuucugucuugcuggcuaauucuuuaauguccucuucggucaauuccguucugguauuacccaaaugcaguuuaaacauuacagcccuggccggcuccuccggcagcgguauguaaauucucuuuucgaaacgucuucgaaucgcagaaucuaauacccacgguauauucguugcuccuaguaccagaaucccuucggugucgugacccacaccuugcauuuggaccaaaaacucgguuuugauccuucuagcagacucagauucguuaucggaacgugaagaacagagcgaaucgaucucaucgaugaagaugaugcugggcuc

SEQ ID NO: 1275 - RNA, 351 nt, artificial sequence
  synthetic construct
guaucaacaaaucgucaacaaucguuuuuggaucagucggagaagguccccuaacuuucuuaaaaugcguggcuguuugcacuuuacguacaggcugcaugagagcaucucgaacaacuauacuuauaucugcacccgaauacccuucugucuugcuggcuaauucuuuaauguccucuucggucaauuccguucugguauuacccaaaugcaguuuaaacauuacagcccuggccggcuccuccggcagcgguauguaaauucucuuuucgaaacgucuucgaaucgcagaaucuaauacccacgguauauucguugcuccuaguaccagaaucccuucggugucgugac

SEQ ID NO: 1276 - RNA, 351 nt, artificial sequence
  synthetic construct
guuaacauaucauucagaguaacgggcggcucggcuaacuuaucacucgguauauccauccaggacauuucuauagcaccaggaucaccuggcgaacacgguaucaacaaaucgucaacaaucguuuuuggaucagucggagaagguccccuaacuuucuuaaaaugcguggcuguuugcacuuuacguacaggcugcaugagagcaucucgaacaacuauacuuauaucugcacccgaauacccuucugucuugcuggcuaauucuuuaauguccucuucggucaauuccguucugguauuacccaaaugcaguuuaaacauuacagcccuggccggcuccuccggcagc

SEQ ID NO: 1277 - RNA, 351 nt, artificial sequence
  synthetic construct
gcaggaucaccuggcgaacacgguaucaacaaaucgucaacaaucguuuuuggaucagucggagaagguccccuaacuuucuuaaaaugcguggcuguuugcacuuuacguacaggcugcaugagagcaucucgaacaacuauacuuauaucugcacccgaauacccuucugucuugcuggcuaauucuuuaauguccucuucggucaauuccguucugguauuacccaaaugcaguuuaaacauuacagcccuggccggcuccuccggcagcgguauguaaauucucuuuucgaaacgucuucgaaucgcagaaucuaauacccacgguauauucguugcuccuaguacc

SEQ ID NO: 1278 - RNA, 352 nt, artificial sequence
  synthetic construct
guaucauucagaguaacgggcggcucggcuaacuuaucacucgguauauccauccaggacauuucuauagcaccaggaucaccuggcgaacacgguaucaacaaaucgucaacaaucguuuuuggaucagucggagaagguccccuaacuuucuuaaaaugcguggcuguuugcacuuuacguacaggcugcaugagagcaucucgaacaacuauacuuauaucugcacccgaauacccuucugucuugcuggcuaauucuuuaauguccucuucggucaauuccguucugguauuacccaaaugcaguuuaaacauuacagcccuggccggcuccuccggcagcgguaugc

SEQ ID NO: 1279 - RNA, 352 nt, artificial sequence
  synthetic construct
gucggucaauuccguucugguauuacccaaaugcaguuuaaacauuacagcccuggccggcuccuccggcagcgguauguaaauucucuuuucgaaacgucuucgaaucgcagaaucuaauacccacgguauauucguugcuccuaguaccagaaucccuucggugucgugacccacaccuugcauuuggaccaaaaacucgguuuugauccuucuagcagacucagauucguuaucggaacgugaagaacagagcgaaucgaucucaucgaugaagaugaugcugggcuugugcgcucgggccaauucgaacagauucuucaccagcuucucggauucacccagccauuuc

SEQ ID NO: 1280 - RNA, 351 nt, artificial sequence
  synthetic construct
gccaggaucaccuggcgaacacgguaucaacaaaucgucaacaaucguuuuuggaucagucggagaagguccccuaacuuucuuaaaaugcguggcuguuugcacuuuacguacaggcugcaugagagcaucucgaacaacuauacuuauaucugcacccgaauacccuucugucuugcuggcuaauucuuuaauguccucuucggucaauuccguucugguauuacccaaaugcaguuuaaacauuacagcccuggccggcuccuccggcagcgguauguaaauucucuuuucgaaacgucuucgaaucgcagaaucuaauacccacgguauauucguugcuccuaguac

SEQ ID NO: 1281 - RNA, 352 nt, artificial sequence
  synthetic construct
guuuaauguccucuucggucaauuccguucugguauuacccaaaugcaguuuaaacauuacagcccuggccggcuccuccggcagcgguauguaaauucucuuuucgaaacgucuucgaaucgcagaaucuaauacccacgguauauucguugcuccuaguaccagaaucccuucggugucgugacccacaccuugcauuuggaccaaaaacucgguuuugauccuucuagcagacucagauucguuaucggaacgugaagaacagagcgaaucgaucucaucgaugaagaugaugcugggcuugugcgcucgggccaauucgaacagauucuucaccagcuucucggauuc

SEQ ID NO: 1282 - RNA, 352 nt, artificial sequence
  synthetic construct
guucucaauuuggucagauccucaucauugacuguugguuucgagguggacacagaucuuaacauaucauucagaguaacgggcggcucggcuaacuuaucacucgguauauccauccaggacauuucuauagcaccaggaucaccuggcgaacacgguaucaacaaaucgucaacaaucguuuuuggaucagucggagaagguccccuaacuuucuuaaaaugcguggcuguuugcacuuuacguacaggcugcaugagagcaucucgaacaacuauacuuauaucugcacccgaauacccuucugucuugcuggcuaauucuuuaauguccucuucggucaauuccguuc

SEQ ID NO: 1283 - RNA, 352 nt, artificial sequence
  synthetic construct
guucuaauucauccucguccaaaucaucagcgaagccuaccggcuggcuaauagcaguaguaaucucguuggcaaugucaugcuguucagcuaugucauccaugaugucguggacaucaucgacauucaaguuuuugugggcuuuuuggagagcuucagcugcauucuucauugaaucuaagacggcuguguuggugcuggcuccuucgagggccucccuuugcauuucgauuguagugagugugccaucgauuuguaauugaguuuuuuccaaucguuuuuucuuuuugagcgccugcagcgcgacucucuuauucuuugaugcauuuuuuuuggcuacuaguguauauuc

SEQ ID NO: 1284 - RNA, 351 nt, artificial sequence
  synthetic construct
guaauagcaguaguaaucucguuggcaaugucaugcuguucagcuaugucauccaugaugucguggacaucaucgacauucaaguuuuugugggcuuuuuggagagcuucagcugcauucuucauugaaucuaagacggcuguguuggugcuggcuccuucgagggccucccuuugcauuucgauuguagugagugugccaucgauuuguaauugaguuuuuuccaaucguuuuuucuuuuugagcgccugcagcgcgacucucuuauucuuugaugcauuuuuuuuggcuacuaguguauauuccucuauuuucuuuucuaaaaacucuuguuuuuuauauaacaugucc

SEQ ID NO: 1285 - RNA, 352 nt, artificial sequence
  synthetic construct
gccaagcuuccaauucuuucaugucaucaucauccuccacuuuuuuagcagcagguuuaacgggcuuggcaauagcuccuguagguacagcagguaguucaguugggccuggaacuuucagcaaaucuuccucuaauccuucuuguucgagcuuuucuaguucgcuuucuaauucauccucguccaaaucaucagcgaagccuaccggcuggcuaauagcaguaguaaucucguuggcaaugucaugcuguucagcuaugucauccaugaugucguggacaucaucgacauucaaguuuuugugggcuuuuuggagagcuucagcugcauucuucauugaaucuaagacggc

SEQ ID NO: 1286 - RNA, 352 nt, artificial sequence
  synthetic construct
guaauccuucuuguucgagcuuuucuaguucgcuuucuaauucauccucguccaaaucaucagcgaagccuaccggcuggcuaauagcaguaguaaucucguuggcaaugucaugcuguucagcuaugucauccaugaugucguggacaucaucgacauucaaguuuuugugggcuuuuuggagagcuucagcugcauucuucauugaaucuaagacggcuguguuggugcuggcuccuucgagggccucccuuugcauuucgauuguagugagugugccaucgauuuguaauugaguuuuuuccaaucguuuuuucuuuuugagcgccugcagcgcgacucucuuauucuc

SEQ ID NO: 1287 - RNA, 352 nt, artificial sequence
  synthetic construct
gagcaguaguaaucucguuggcaaugucaugcuguucagcuaugucauccaugaugucguggacaucaucgacauucaaguuuuugugggcuuuuuggagagcuucagcugcauucuucauugaaucuaagacggcuguguuggugcuggcuccuucgagggccucccuuugcauuucgauuguagugagugugccaucgauuuguaauugaguuuuuuccaaucguuuuuucuuuuugagcgccugcagcgcgacucucuuauucuuugaugcauuuuuuuuggcuacuaguguauauuccucuauuuucuuuucuaaaaacucuuguuuuuuauauaacauguccucggc

SEQ ID NO: 1288 - RNA, 351 nt, artificial sequence
  synthetic construct
guucaugucaucaucauccuccacuuuuuuagcagcagguuuaacgggcuuggcaauagcuccuguagguacagcagguaguucaguugggccuggaacuuucagcaaaucuuccucuaauccuucuuguucgagcuuuucuaguucgcuuucuaauucauccucguccaaaucaucagcgaagccuaccggcuggcuaauagcaguaguaaucucguuggcaaugucaugcuguucagcuaugucauccaugaugucguggacaucaucgacauucaaguuuuugugggcuuuuuggagagcuucagcugcauucuucauugaaucuaagacggcuguguuggugcuggc

SEQ ID NO: 1289 - RNA, 352 nt, artificial sequence
  synthetic construct
gugggcuuuuuggagagcuucagcugcauucuucauugaaucuaagacggcuguguuggugcuggcuccuucgagggccucccuuugcauuucgauuguagugagugugccaucgauuuguaauugaguuuuuuccaaucguuuuuucuuuuugagcgccugcagcgcgacucucuuauucuuugaugcauuuuuuuuggcuacuaguguauauuccucuauuuucuuuucuaaaaacucuuguuuuuuauauaacauguccucgguuucccugagcuuuuggauggcuucgccuggcguggggcccacauccuuuucuuuuccuccgaauauuuuacuaaagaaacucauc

SEQ ID NO: 1290 - RNA, 352 nt, artificial sequence
  synthetic construct
guuucuaauucauccucguccaaaucaucagcgaagccuaccggcuggcuaauagcaguaguaaucucguuggcaaugucaugcuguucagcuaugucauccaugaugucguggacaucaucgacauucaaguuuuugugggcuuuuuggagagcuucagcugcauucuucauugaaucuaagacggcuguguuggugcuggcuccuucgagggccucccuuugcauuucgauuguagugagugugccaucgauuuguaauugaguuuuuuccaaucguuuuuucuuuuugagcgccugcagcgcgacucucuuauucuuugaugcauuuuuuuuggcuacuaguguauauc

SEQ ID NO: 1291 - RNA, 352 nt, artificial sequence
  synthetic construct
guuucagcaaaucuuccucuaauccuucuuguucgagcuuuucuaguucgcuuucuaauucauccucguccaaaucaucagcgaagccuaccggcuggcuaauagcaguaguaaucucguuggcaaugucaugcuguucagcuaugucauccaugaugucguggacaucaucgacauucaaguuuuugugggcuuuuuggagagcuucagcugcauucuucauugaaucuaagacggcuguguuggugcuggcuccuucgagggccucccuuugcauuucgauuguagugagugugccaucgauuuguaauugaguuuuuuccaaucguuuuuucuuuuugagcgccugcac

SEQ ID NO: 1292 - RNA, 351 nt, artificial sequence
  synthetic construct
gugugggcuuuuuggagagcuucagcugcauucuucauugaaucuaagacggcuguguuggugcuggcuccuucgagggccucccuuugcauuucgauuguagugagugugccaucgauuuguaauugaguuuuuuccaaucguuuuuucuuuuugagcgccugcagcgcgacucucuuauucuuugaugcauuuuuuuuggcuacuaguguauauuccucuauuuucuuuucuaaaaacucuuguuuuuuauauaacauguccucgguuucccugagcuuuuggauggcuucgccuggcguggggcccacauccuuuucuuuuccuccgaauauuuuacuaaagaaacuc

SEQ ID NO: 1293 - RNA, 351 nt, artificial sequence
  synthetic construct
guucuuucaugucaucaucauccuccacuuuuuuagcagcagguuuaacgggcuuggcaauagcuccuguagguacagcagguaguucaguugggccuggaacuuucagcaaaucuuccucuaauccuucuuguucgagcuuuucuaguucgcuuucuaauucauccucguccaaaucaucagcgaagccuaccggcuggcuaauagcaguaguaaucucguuggcaaugucaugcuguucagcuaugucauccaugaugucguggacaucaucgacauucaaguuuuugugggcuuuuuggagagcuucagcugcauucuucauugaaucuaagacggcuguguuggugc

SEQ ID NO: 1294 - RNA, 253 nt, artificial sequence
  synthetic construct
gauuauagcacgucuaucggcuucgaaagccaggauuucgcacaugcugucagcaguggugccuccgauuuccuugcagaaggugaagaaagccuccaaguaggcuuuguacagaguguuccugaugauuucgauguucaucucguccaaaucuugcucgcugaugcaaucgacgaagaaaggagcuagcggagugucuacuaacaccgcguuguacaauuccgcuggaguggcugcuacguggauggcuucc

SEQ ID NO: 1295 - RNA, 260 nt, artificial sequence
  synthetic construct
guuaucgaucauguaacuguaggugaugaaguccaggaauguggacagggguucuacggcuugguuacgcauaugcuggaacucgaugacgaguuuuucccucaauuugucgucgaugguggauacugacaauggggaggguucguuggccaggaacgugccguagucugugccuuguaaaugcagcuucaaaucuuccagaguuucgcauugcacuaaauugagguaaucggcuugcuucaauaugccgcauuugaagc

SEQ ID NO: 1296 - RNA, 262 nt, artificial sequence
  synthetic construct
gucuuaucucccggauuguuuccagcccccucgaacaauuuggaguacucagcauaauacucggccacagcuuugaccugcucguaauccucagcucuagcuagagcggccaaaccaucaggcuggaguuuuccgcaacgcggguacaacuuagcgcggucaucuuugcucaauuccguuccgaaggaguugauagugaugauuauagcacgucuaucggcuucgaaagccaggauuucgcacaugcugucagcaguggugc

SEQ ID NO: 1297 - RNA, 253 nt, artificial sequence
  synthetic construct
gauuaaaagaauuauguuaucgaucauguaacuguaggugaugaaguccaggaauguggacagggguucuacggcuugguuacgcauaugcuggaacucgaugacgaguuuuucccucaauuugucgucgaugguggauacugacaauggggaggguucguuggccaggaacgugccguagucugugccuuguaaaugcagcuucaaaucuuccagaguuucgcauugcacuaaauugagguaaucggcuugc

SEQ ID NO: 1298 - RNA, 258 nt, artificial sequence
  synthetic construct
gaucuuggcccugugcuucugagccacgcacucugcgauccaaacgauguuccugcauuccugcuccuucagcuucaaauaggaauagaacacaccgaaguggaacuguugcaugaacgcguugauguucaggcgcacuucaugcucgaagaauuuguccuccaacgucuuaucucccggauuguuuccagcccccucgaacaauuuggaguacucagcauaauacucggccacagcuuugaccugcucguaauccuc

SEQ ID NO: 1299 - RNA, 352 nt, artificial sequence
  synthetic construct
gucgauuuucuuggccucacgguacuuuuucaacaaacgacgaaggacucucauacguugaauccauaauucuuuucuugguguucgagcguucgcuguaccuuuccuuuuaccaaaaccgcagugccuacccuuccugcgggcuucgguguucuugcggacacgggcacgugagugcacugcuacaggcuucuugaugaucaaaccaucuuuaaucagcuugcggauguuuugucuugaauuuguauuggcgauuucguugauuucguuaggauccaaccauaccuucuuuuugccgcaucucauaacagaggcugcgagccucuucuggaguuuuaacgaacucauuuuc

SEQ ID NO: 1300 - RNA, 351 nt, artificial sequence
  synthetic construct
gauucugcaaaacuuccugcuucuucguagcgauacguucuucacgucuuucccuggcgcguuugaccuucauucucuuggcguucgccuggucggccaacaucuuggcgcgagccuucucagccuucuucuuguggauguauuccaucaggacacgcuuguucuugaauacguuacccuuugccuucauguacagcgaaugguacagaugucugucgauuuucuuggccucacgguacuuuuucaacaaacgacgaaggacucucauacguugaauccauaauucuuuucuugguguucgagcguucgcuguaccuuuccuuuuaccaaaaccgcagugccuacccuucc

SEQ ID NO: 1301 - RNA, 351 nt, artificial sequence
  synthetic construct
guauuuuuuaguagcagcggcagcuucgucuucccucugguaauucugcaaaacuuccugcuucuucguagcgauacguucuucacgucuuucccuggcgcguuugaccuucauucucuuggcguucgccuggucggccaacaucuuggcgcgagccuucucagccuucuucuuguggauguauuccaucaggacacgcuuguucuugaauacguuacccuuugccuucauguacagcgaaugguacagaugucugucgauuuucuuggccucacgguacuuuuucaacaaacgacgaaggacucucauacguugaauccauaauucuuuucuugguguucgagcguucgc

SEQ ID NO: 1302 - RNA, 352 nt, artificial sequence
  synthetic construct
guuguucuugaauacguuacccuuugccuucauguacagcgaaugguacagaugucugucgauuuucuuggccucacgguacuuuuucaacaaacgacgaaggacucucauacguugaauccauaauucuuuucuugguguucgagcguucgcuguaccuuuccuuuuaccaaaaccgcagugccuacccuuccugcgggcuucgguguucuugcggacacgggcacgugagugcacugcuacaggcuucuugaugaucaaaccaucuuuaaucagcuugcggauguuuugucuugaauuuguauuggcgauuucguugauuucguuaggauccaaccauaccuucuuuuuc

SEQ ID NO: 1303 - RNA, 351 nt, artificial sequence
  synthetic construct
guuacccuuugccuucauguacagcgaaugguacagaugucugucgauuuucuuggccucacgguacuuuuucaacaaacgacgaaggacucucauacguugaauccauaauucuuuucuugguguucgagcguucgcuguaccuuuccuuuuaccaaaaccgcagugccuacccuuccugcgggcuucgguguucuugcggacacgggcacgugagugcacugcuacaggcuucuugaugaucaaaccaucuuuaaucagcuugcggauguuuugucuugaauuuguauuggcgauuucguugauuucguuaggauccaaccauaccuucuuuuugccgcaucucauaac

SEQ ID NO: 1304 - RNA, 352 nt, artificial sequence
  synthetic construct
guuccuuaacucuaucuuucuuaagaggucccauaaacgcagccuugucggcggcgguuuggaaucuaccguguccgaauuuggacgacguaucgaugaauuucaaauugaucuucuccaaagcaauacgcuuagugugaaccaagagagauuuucucaguguaaugacacgcuucuuaggucccauacaacaacccuuaaucaugacgaagucauuguuaacuucaccauaaugagggaaaccacccauugguguaauggucuucucacuaagaucguaaucgguagcagcauuguuuuugaugaccuuuccguccuuagugugaauuccagcaccgauucuguagauuuc

SEQ ID NO: 1305 - RNA, 351 nt, artificial sequence
  synthetic construct
gcuucguaugccaacgagauguaacaccuuuguauccaugaccuuugguuacaccgaugcaaucgaucaucucaucuugagcgaaaacguugccaacgggaaugggcuucuccaaaugcuccuuagcccaugcgacuuugucggcaaugguaccuccguugaguugaauuuccauaauaugggcuuucuuuugacguuguuucaacaauuucaucugagugugagcgaugacucugacaaccuugcaguauuugacgauuuucuucaagucgcgcucaauggacuucuuacccaaaucaucgguccauuucuuggacgccuuggugaaagccuucuucuugcucuuguacc

SEQ ID NO: 1306 - RNA, 352 nt, artificial sequence
  synthetic construct
guuucaaauugaucuucuccaaagcaauacgcuuagugugaaccaagagagauuuucucaguguaaugacacgcuucuuaggucccauacaacaacccuuaaucaugacgaagucauuguuaacuucaccauaaugagggaaaccacccauugguguaauggucuucucacuaagaucguaaucgguagcagcauuguuuuugaugaccuuuccguccuuagugugaauuccagcaccgauucuguagauuuucuuguucaucuccguccugugaugguaacccuuuugaccagcacgagcgacagugaaugacacucgagaaggaugccaggcuccaauacaggcgacuuc

SEQ ID NO: 1307 - RNA, 351 nt, artificial sequence
  synthetic construct
guaacucgaagcagcagcugcagcuggggccgcagucuugucuucuuccuuaacucuaucuuucuuaagaggucccauaaacgcagccuugucggcggcgguuuggaaucuaccguguccgaauuuggacgacguaucgaugaauuucaaauugaucuucuccaaagcaauacgcuuagugugaaccaagagagauuuucucaguguaaugacacgcuucuuaggucccauacaacaacccuuaaucaugacgaagucauuguuaacuucaccauaaugagggaaaccacccauugguguaauggucuucucacuaagaucguaaucgguagcagcauuguuuuugaugac

SEQ ID NO: 1308 - RNA, 352 nt, artificial sequence
  synthetic construct
guugucuucuuccuuaacucuaucuuucuuaagaggucccauaaacgcagccuugucggcggcgguuuggaaucuaccguguccgaauuuggacgacguaucgaugaauuucaaauugaucuucuccaaagcaauacgcuuagugugaaccaagagagauuuucucaguguaaugacacgcuucuuaggucccauacaacaacccuuaaucaugacgaagucauuguuaacuucaccauaaugagggaaaccacccauugguguaauggucuucucacuaagaucguaaucgguagcagcauuguuuuugaugaccuuuccguccuuagugugaauuccagcaccgauucuc

SEQ ID NO: 1309 - RNA, 352 nt, artificial sequence
  synthetic construct
gcguugaacuagcugaacaguaggaauugguucuuuguaaaccagguaauacuguugggccauuuuacgugcuugcuugaccaacaaacgguagucaggucccaucccggaauagaccauuccgaugugcuucgugaucauuucuacuuuauggacgcuguguucgucguaaagaauggauuugugcuuguuuucuguggcuauuaccacuccauuugaugcuuuuauuccuacugaaggagcaccagccgccacugccgcuaaagcauauucgauuuggacuaguuuaccugaagggcugaaaguuguuaaagaaaaacuauaacguucagaugacauuuucacaaaugac

SEQ ID NO: 1310 - RNA, 352 nt, artificial sequence
  synthetic construct
gauuccugcauuacaguugcaacacguugaacuagcugaacaguaggaauugguucuuuguaaaccagguaauacuguugggccauuuuacgugcuugcuugaccaacaaacgguagucaggucccaucccggaauagaccauuccgaugugcuucgugaucauuucuacuuuauggacgcuguguucgucguaaagaauggauuugugcuuguuuucuguggcuauuaccacuccauuugaugcuuuuauuccuacugaaggagcaccagccgccacugccgcuaaagcauauucgauuuggacuaguuuaccugaagggcugaaaguuguuaaagaaaaacuauaacguc

SEQ ID NO: 1311 - RNA, 352 nt, artificial sequence
  synthetic construct
gcaacacguugaacuagcugaacaguaggaauugguucuuuguaaaccagguaauacuguugggccauuuuacgugcuugcuugaccaacaaacgguagucaggucccaucccggaauagaccauuccgaugugcuucgugaucauuucuacuuuauggacgcuguguucgucguaaagaauggauuugugcuuguuuucuguggcuauuaccacuccauuugaugcuuuuauuccuacugaaggagcaccagccgccacugccgcuaaagcauauucgauuuggacuaguuuaccugaagggcugaaaguuguuaaagaaaaacuauaacguucagaugacauuuucacac

SEQ ID NO: 1312 - RNA, 352 nt, artificial sequence
  synthetic construct
gugcaacacguugaacuagcugaacaguaggaauugguucuuuguaaaccagguaauacuguugggccauuuuacgugcuugcuugaccaacaaacgguagucaggucccaucccggaauagaccauuccgaugugcuucgugaucauuucuacuuuauggacgcuguguucgucguaaagaauggauuugugcuuguuuucuguggcuauuaccacuccauuugaugcuuuuauuccuacugaaggagcaccagccgccacugccgcuaaagcauauucgauuuggacuaguuuaccugaagggcugaaaguuguuaaagaaaaacuauaacguucagaugacauuuucac

SEQ ID NO: 1313 - RNA, 350 nt, artificial sequence
  synthetic construct
gcaagcgccacccauuuucuccuuuuccuccacaaacuuguaaugcaaguccaugcaaucauuaucaucgaugugcacccaaccagucucuuucaugugguacacucuaacaauaccuccugaauaggcgucucuaugaguagcgugguaaaucgaucuacgaccuaaaucauaagcuuccucaucggauaagucccauuuguauccagaaucaagcaccccgaaagcguaaauggaaccugaaccuacgcugaacacuuucccggcuguccuuagaccuucugaaucgacguaguagaguugaggaccccuuuugucccauccagccaacaucauucccauggacaaac

SEQ ID NO: 1314 - RNA, 351 nt, artificial sequence
  synthetic construct
gcuccugaauaggcgucucuaugaguagcgugguaaaucgaucuacgaccuaaaucauaagcuuccucaucggauaagucccauuuguauccagaaucaagcaccccgaaagcguaaauggaaccugaaccuacgcugaacacuuucccggcuguccuuagaccuucugaaucgacguaguagaguugaggaccccuuuugucccauccagccaacaucauucccauggacaaacccauuccuuuguaauuauaaaccauauuggccauuaacuuggaagccgcagccaccgaaauacguucccuguuucucaguucguacagccuacauuguuuagcuaauacucggucc

SEQ ID NO: 1315 - RNA, 351 nt, artificial sequence
  synthetic construct
guuucucaguucguacagccuacauuguuuagcuaauacucggucccaguacguacaaucagccgcgccuccugccauuguagcuagcaaaaaacuguugauuuuuaugauuuuuucuacaguuugugauccaaugaauuggccuccaguggcucgggaauccacugcgaguacuacgccccccuuguacaugaaucccaauguggugguaccguggucgaacuuaauuuugaucucacggccauuaucaucuuuggugaaucuugcaaaguuauugcugggaucaggaaaaggcggaacggccaaguucaugccauugaaauuggugcaauacuucugcagacucucguc

SEQ ID NO: 1316 - RNA, 352 nt, artificial sequence
  synthetic construct
gccugccauuguagcuagcaaaaaacuguugauuuuuaugauuuuuucuacaguuugugauccaaugaauuggccuccaguggcucgggaauccacugcgaguacuacgccccccuuguacaugaaucccaauguggugguaccguggucgaacuuaauuuugaucucacggccauuaucaucuuuggugaaucuugcaaaguuauugcugggaucaggaaaaggcggaacggccaaguucaugccauugaaauuggugcaauacuucugcagacucucgucguaggcgagucgcucguaauccucggaauuguagcuuguaaugcccgauaacgcuucuaaacucaugauc

SEQ ID NO: 1317 - RNA, 352 nt, artificial sequence
  synthetic construct
guaccuccugaauaggcgucucuaugaguagcgugguaaaucgaucuacgaccuaaaucauaagcuuccucaucggauaagucccauuuguauccagaaucaagcaccccgaaagcguaaauggaaccugaaccuacgcugaacacuuucccggcuguccuuagaccuucugaaucgacguaguagaguugaggaccccuuuugucccauccagccaacaucauucccauggacaaacccauuccuuuguaauuauaaaccauauuggccauuaacuuggaagccgcagccaccgaaauacguucccuguuucucaguucguacagccuacauuguuuagcuaauacucggc

SEQ ID NO: 1318 - RNA, 351 nt, artificial sequence
  synthetic construct
gcauucccauggacaaacccauuccuuuguaauuauaaaccauauuggccauuaacuuggaagccgcagccaccgaaauacguucccuguuucucaguucguacagccuacauuguuuagcuaauacucggucccaguacguacaaucagccgcgccuccugccauuguagcuagcaaaaaacuguugauuuuuaugauuuuuucuacaguuugugauccaaugaauuggccuccaguggcucgggaauccacugcgaguacuacgccccccuuguacaugaaucccaauguggugguaccguggucgaacuuaauuuugaucucacggccauuaucaucuuuggugaauc

SEQ ID NO: 1319 - RNA, 352 nt, artificial sequence
  synthetic construct
gcuccugccauuguagcuagcaaaaaacuguugauuuuuaugauuuuuucuacaguuugugauccaaugaauuggccuccaguggcucgggaauccacugcgaguacuacgccccccuuguacaugaaucccaauguggugguaccguggucgaacuuaauuuugaucucacggccauuaucaucuuuggugaaucuugcaaaguuauugcugggaucaggaaaaggcggaacggccaaguucaugccauugaaauuggugcaauacuucugcagacucucgucguaggcgagucgcucguaauccucggaauuguagcuuguaaugcccgauaacgcuucuaaacucaugc

SEQ ID NO: 1320 - RNA, 346 nt, artificial sequence
  synthetic construct
gcacgucccuuugaugauaagcuaugucggcggccucuuccaagcacccggcuuugaugcaguauuugacuuugaugucgucgccgacuuugggcagauauuugagggccuccugccguuuguccugccucaagcaaacguccacgaagggagcguauccgauaggggacuucuucgcuuuggaaaacuuuuccagcucgauccaaucguucugaucggccaggcuguugauuuucaaccaccaauaccuuuuaucgggaauuuugaagucguucuugaacuucucggccaacuuggucuccuucauguccaacaggauccugcaggucucguggacugauuuccc

SEQ ID NO: 1321 - RNA, 352 nt, artificial sequence
  synthetic construct
guggucucgggugacuucgccgaggcgcuugcgggcgucuucuagcacggcccucacguggucuucucucacuuucaacaccuucaaucuggccugguucagcauguuggacgauuggauuuucuucuggagcucgacuuguuucuccuucuucucguaguauuccaugaucuugaggcgcugcuguuggaccaaacggcccuuuucuauguugaacuccuccucggcuuuggcaucgauuucuucggccuucucguuggccucuugcucgaugaaagccaucaugugcuugaucuguuucuggacaucugcgucgcucagagccaucguggaugcgauuucggguauuugc

SEQ ID NO: 1322 - RNA, 352 nt, artificial sequence
  synthetic construct
guacuucuuucucgaacagcugguagaguccuugaaggaugaggcuuucgaugauguggccguacuuucccuggucucgggugacuucgccgaggcgcuugcgggcgucuucuagcacggcccucacguggucuucucucacuuucaacaccuucaaucuggccugguucagcauguuggacgauuggauuuucuucuggagcucgacuuguuucuccuucuucucguaguauuccaugaucuugaggcgcugcuguuggaccaaacggcccuuuucuauguugaacuccuccucggcuuuggcaucgauuucuucggccuucucguuggccucuugcucgaugaaagccac

SEQ ID NO: 1323 - RNA, 351 nt, artificial sequence
  synthetic construct
guuacuucuuucucgaacagcugguagaguccuugaaggaugaggcuuucgaugauguggccguacuuucccuggucucgggugacuucgccgaggcgcuugcgggcgucuucuagcacggcccucacguggucuucucucacuuucaacaccuucaaucuggccugguucagcauguuggacgauuggauuuucuucuggagcucgacuuguuucuccuucuucucguaguauuccaugaucuugaggcgcugcuguuggaccaaacggcccuuuucuauguugaacuccuccucggcuuuggcaucgauuucuucggccuucucguuggccucuugcucgaugaaagcc

SEQ ID NO: 1324 - RNA, 351 nt, artificial sequence
  synthetic construct
gugcacguugcccagaaucgacuugaccagcucccuguccugcgggcgcacccugaccguuacuucuuucucgaacagcugguagaguccuugaaggaugaggcuuucgaugauguggccguacuuucccuggucucgggugacuucgccgaggcgcuugcgggcgucuucuagcacggcccucacguggucuucucucacuuucaacaccuucaaucuggccugguucagcauguuggacgauuggauuuucuucuggagcucgacuuguuucuccuucuucucguaguauuccaugaucuugaggcgcugcuguuggaccaaacggcccuuuucuauguugaacuccuc

SEQ ID NO: 1325 - RNA, 352 nt, artificial sequence
  synthetic construct
guucuuucucgaacagcugguagaguccuugaaggaugaggcuuucgaugauguggccguacuuucccuggucucgggugacuucgccgaggcgcuugcgggcgucuucuagcacggcccucacguggucuucucucacuuucaacaccuucaaucuggccugguucagcauguuggacgauuggauuuucuucuggagcucgacuuguuucuccuucuucucguaguauuccaugaucuugaggcgcugcuguuggaccaaacggcccuuuucuauguugaacuccuccucggcuuuggcaucgauuucuucggccuucucguuggccucuugcucgaugaaagccaucac

SEQ ID NO: 1326 - RNA, 351 nt, artificial sequence
  synthetic construct
guaaucggugaacuuccuguucacguuacgcccgaacaaagcguuacguauuuggggcaccaauugcugcgaaaucaaauccaaucgcgccucgagcguguuguugaucuucacuuuauucuucagcgccagcaaaucgaucccuccgguggucuccugcgacaagugcgacucaucgucgaucuucaagugcaccucuuugcccgugauguccuuguacuugguuugcacguugcccagaaucgacuugaccagcucccuguccugcgggcgcacccugaccguuacuucuuucucgaacagcugguagaguccuugaaggaugaggcuuucgaugauguggccguacuc

SEQ ID NO: 1327 - RNA, 352 nt, artificial sequence
  synthetic construct
guucaagugcaccucuuugcccgugauguccuuguacuugguuugcacguugcccagaaucgacuugaccagcucccuguccugcgggcgcacccugaccguuacuucuuucucgaacagcugguagaguccuugaaggaugaggcuuucgaugauguggccguacuuucccuggucucgggugacuucgccgaggcgcuugcgggcgucuucuagcacggcccucacguggucuucucucacuuucaacaccuucaaucuggccugguucagcauguuggacgauuggauuuucuucuggagcucgacuuguuucuccuucuucucguaguauuccaugaucuugaggcgc

SEQ ID NO: 1328 - RNA, 351 nt, artificial sequence
  synthetic construct
gaaauguugcucaucgaaucccugaucaccguccacgugaucuuguucucagauugagcagucgacuccacggcgugucucgccauaucguacaucccaaucauguucuucaacauacccacgguuuuguagaagggacagaaucuaucguacgaugaguacgaguucuguugcaggaaaucuucuuucaacagcuuggcgauuuccaauguaaucuuaucagcuucagcuaaugaagcuuuuccuaccagcugcacgauuuccguaaggucgucuucuucuugaaggauuucuuuaacuuugguucuuagcgguauaaauucagggaaguuuuugucauagaaaucaucc

SEQ ID NO: 1329 - RNA, 352 nt, artificial sequence
  synthetic construct
guaaucuuaucagcuucagcuaaugaagcuuuuccuaccagcugcacgauuuccguaaggucgucuucuucuugaaggauuucuuuaacuuugguucuuagcgguauaaauucagggaaguuuuugucauagaaaucauccaaagcccucaaauauuuagaguaugaacucagccagucgacagacgggaagugcuuacguugggcaagcuucuuguccaauccccaaaacacuugaacgauaccaagaguagcggaagugacaggaucagagaaaucaccaccaggcggcgacacggcuccuacgaucgaaacagacccuucccuaucgggguuacccaagcacuuaacgc

SEQ ID NO: 1330 - RNA, 352 nt, artificial sequence
  synthetic construct
guuuccaauguaaucuuaucagcuucagcuaaugaagcuuuuccuaccagcugcacgauuuccguaaggucgucuucuucuugaaggauuucuuuaacuuugguucuuagcgguauaaauucagggaaguuuuugucauagaaaucauccaaagcccucaaauauuuagaguaugaacucagccagucgacagacgggaagugcuuacguugggcaagcuucuuguccaauccccaaaacacuugaacgauaccaagaguagcggaagugacaggaucagagaaaucaccaccaggcggcgacacggcuccuacgaucgaaacagacccuucccuaucgggguuacccaagc

SEQ ID NO: 1331 - RNA, 352 nt, artificial sequence
  synthetic construct
gaacuucauacugcucaauugguacaaaauguugcucaucgaaucccugaucaccguccacgugaucuuguucucagauugagcagucgacuccacggcgugucucgccauaucguacaucccaaucauguucuucaacauacccacgguuuuguagaagggacagaaucuaucguacgaugaguacgaguucuguugcaggaaaucuucuuucaacagcuuggcgauuuccaauguaaucuuaucagcuucagcuaaugaagcuuuuccuaccagcugcacgauuuccguaaggucgucuucuucuugaaggauuucuuuaacuuugguucuuagcgguauaaauucaggc

SEQ ID NO: 1332 - RNA, 351 nt, artificial sequence
  synthetic construct
gacgugaucuuguucucagauugagcagucgacuccacggcgugucucgccauaucguacaucccaaucauguucuucaacauacccacgguuuuguagaagggacagaaucuaucguacgaugaguacgaguucuguugcaggaaaucuucuuucaacagcuuggcgauuuccaauguaaucuuaucagcuucagcuaaugaagcuuuuccuaccagcugcacgauuuccguaaggucgucuucuucuugaaggauuucuuuaacuuugguucuuagcgguauaaauucagggaaguuuuugucauagaaaucauccaaagcccucaaauauuuagaguaugaacucagc

SEQ ID NO: 1333 - RNA, 351 nt, artificial sequence
  synthetic construct
gaaaauguugcucaucgaaucccugaucaccguccacgugaucuuguucucagauugagcagucgacuccacggcgugucucgccauaucguacaucccaaucauguucuucaacauacccacgguuuuguagaagggacagaaucuaucguacgaugaguacgaguucuguugcaggaaaucuucuuucaacagcuuggcgauuuccaauguaaucuuaucagcuucagcuaaugaagcuuuuccuaccagcugcacgauuuccguaaggucgucuucuucuugaaggauuucuuuaacuuugguucuuagcgguauaaauucagggaaguuuuugucauagaaaucauc

SEQ ID NO: 1334 - RNA, 351 nt, artificial sequence
  synthetic construct
gucaccggauccuugaacuucauacugcucaauugguacaaaauguugcucaucgaaucccugaucaccguccacgugaucuuguucucagauugagcagucgacuccacggcgugucucgccauaucguacaucccaaucauguucuucaacauacccacgguuuuguagaagggacagaaucuaucguacgaugaguacgaguucuguugcaggaaaucuucuuucaacagcuuggcgauuuccaauguaaucuuaucagcuucagcuaaugaagcuuuuccuaccagcugcacgauuuccguaaggucgucuucuucuugaaggauuucuuuaacuuugguucuuagc

SEQ ID NO: 1335 - RNA, 352 nt, artificial sequence
  synthetic construct
gucauguucuucaacauacccacgguuuuguagaagggacagaaucuaucguacgaugaguacgaguucuguugcaggaaaucuucuuucaacagcuuggcgauuuccaauguaaucuuaucagcuucagcuaaugaagcuuuuccuaccagcugcacgauuuccguaaggucgucuucuucuugaaggauuucuuuaacuuugguucuuagcgguauaaauucagggaaguuuuugucauagaaaucauccaaagcccucaaauauuuagaguaugaacucagccagucgacagacgggaagugcuuacguugggcaagcuucuuguccaauccccaaaacacuugaacgc

SEQ ID NO: 1336 - RNA, 352 nt, artificial sequence
  synthetic construct
guccuugaacuucauacugcucaauugguacaaaauguugcucaucgaaucccugaucaccguccacgugaucuuguucucagauugagcagucgacuccacggcgugucucgccauaucguacaucccaaucauguucuucaacauacccacgguuuuguagaagggacagaaucuaucguacgaugaguacgaguucuguugcaggaaaucuucuuucaacagcuuggcgauuuccaauguaaucuuaucagcuucagcuaaugaagcuuuuccuaccagcugcacgauuuccguaaggucgucuucuucuugaaggauuucuuuaacuuugguucuuagcgguauaaac

SEQ ID NO: 1337 - RNA, 352 nt, artificial sequence
  synthetic construct
gccagucgacagacgggaagugcuuacguugggcaagcuucuuguccaauccccaaaacacuugaacgauaccaagaguagcggaagugacaggaucagagaaaucaccaccaggcggcgacacggcuccuacgaucgaaacagacccuucccuaucgggguuacccaagcacuuaacgcgaccggcgcgcucguagaaagaggccaaucgggcccccaaguaggccggguaaccggaaucggcgggcaucucggccaaacgaccggaaauuucucucaacgccucggcccaacgggacguggaaucggccaucaucgauacgugguaacccaugucucugaaguacucggc

SEQ ID NO: 1338 - RNA, 352 nt, artificial sequence
  synthetic construct
gaccggauccuugaacuucauacugcucaauugguacaaaauguugcucaucgaaucccugaucaccguccacgugaucuuguucucagauugagcagucgacuccacggcgugucucgccauaucguacaucccaaucauguucuucaacauacccacgguuuuguagaagggacagaaucuaucguacgaugaguacgaguucuguugcaggaaaucuucuuucaacagcuuggcgauuuccaauguaaucuuaucagcuucagcuaaugaagcuuuuccuaccagcugcacgauuuccguaaggucgucuucuucuugaaggauuucuuuaacuuugguucuuagcggc

SEQ ID NO: 1339 - RNA, 351 nt, artificial sequence
  synthetic construct
gaucgauguguaugucguucaaaacgacuacauuccuguccgaagcggcgccugucacgucguacacgauguuaccgaauaugauaccauucucggucgaggccacuuucacguuagccuugauauugcagaaauccuucggcgccagaacgaccggcugaggcuucuccaccaacuucaaaucgcccagagucgccaacuccagaguacaauucugcagcgugucgcucguuugguucaccaccaacacguccagcacgauaucguacugauuaacgugcacauacgcuucggaguaaacaggauccgagaaacccgucaacugggcgaucuuguucaauuuacucgagc

SEQ ID NO: 1340 - RNA, 352 nt, artificial sequence
  synthetic construct
guucaaaacgacuacauuccuguccgaagcggcgccugucacgucguacacgauguuaccgaauaugauaccauucucggucgaggccacuuucacguuagccuugauauugcagaaauccuucggcgccagaacgaccggcugaggcuucuccaccaacuucaaaucgcccagagucgccaacuccagaguacaauucugcagcgugucgcucguuugguucaccaccaacacguccagcacgauaucguacugauuaacgugcacauacgcuucggaguaaacaggauccgagaaacccgucaacugggcgaucuuguucaauuuacucgagccgaugguggaguccgac

SEQ ID NO: 1341 - RNA, 351 nt, artificial sequence
  synthetic construct
guaauaucgauguguaugucguucaaaacgacuacauuccuguccgaagcggcgccugucacgucguacacgauguuaccgaauaugauaccauucucggucgaggccacuuucacguuagccuugauauugcagaaauccuucggcgccagaacgaccggcugaggcuucuccaccaacuucaaaucgcccagagucgccaacuccagaguacaauucugcagcgugucgcucguuugguucaccaccaacacguccagcacgauaucguacugauuaacgugcacauacgcuucggaguaaacaggauccgagaaacccgucaacugggcgaucuuguucaauuuacuc

SEQ ID NO: 1342 - RNA, 352 nt, artificial sequence
  synthetic construct
gcucugaugucaggcacuucauguuaguacucuucagcagaugcuccagguacucguugagauccgucagcggcguauugacggucaccuuauucucccauucgaauucagcccacauccucauaaacuccgaaucggugcacgaugccggaacaauguaauccauaauaucgauguguaugucguucaaaacgacuacauuccuguccgaagcggcgccugucacgucguacacgauguuaccgaauaugauaccauucucggucgaggccacuuucacguuagccuugauauugcagaaauccuucggcgccagaacgaccggcugaggcuucuccaccaacuucaaauc

SEQ ID NO: 1343 - RNA, 351 nt, artificial sequence
  synthetic construct
guacauauuggccgccaugaagccgcauugcccgccgagcgccuucucugaugucaggcacuucauguuaguacucuucagcagaugcuccagguacucguugagauccgucagcggcguauugacggucaccuuauucucccauucgaauucagcccacauccucauaaacuccgaaucggugcacgaugccggaacaauguaauccauaauaucgauguguaugucguucaaaacgacuacauuccuguccgaagcggcgccugucacgucguacacgauguuaccgaauaugauaccauucucggucgaggccacuuucacguuagccuugauauugcagaaauccuc

SEQ ID NO: 1344 - RNA, 350 nt, artificial sequence
  synthetic construct
gcaaugguaccuccguugaguugaauuuccauaauaugggcuuucuuuugacguuguuucaacaauuucaucugagugugagcgaugacucugacaaccuugcaguauuugacgauuuucuucaagucgcgcucaauggacuucuuacccaaaucaucgguccauuucuuggacgccuuggugaaagccuucuucuugcucuuguaccaguucuuguagaaacgucuacggcaaucuucggacaaauguucagcccaaacgguggccaaagcucucauaccaugcggaguuucgauguaacccacaacaccuacuacaaucaucggaggaguuuccaaaaugguuacagc

SEQ ID NO: 1345 - RNA, 352 nt, artificial sequence
  synthetic construct
gaauacaggcgacuuuccuaagacccuugugcgucuugcggggcaauuucuucguaugccaacgagauguaacaccuuuguauccaugaccuuugguuacaccgaugcaaucgaucaucucaucuugagcgaaaacguugccaacgggaaugggcuucuccaaaugcuccuuagcccaugcgacuuugucggcaaugguaccuccguugaguugaauuuccauaauaugggcuuucuuuugacguuguuucaacaauuucaucugagugugagcgaugacucugacaaccuugcaguauuugacgauuuucuucaagucgcgcucaauggacuucuuacccaaaucaucggc

SEQ ID NO: 1346 - RNA, 351 nt, artificial sequence
  synthetic construct
guucaacaauuucaucugagugugagcgaugacucugacaaccuugcaguauuugacgauuuucuucaagucgcgcucaauggacuucuuacccaaaucaucgguccauuucuuggacgccuuggugaaagccuucuucuugcucuuguaccaguucuuguagaaacgucuacggcaaucuucggacaaauguucagcccaaacgguggccaaagcucucauaccaugcggaguuucgauguaacccacaacaccuacuacaaucaucggaggaguuuccaaaaugguuacagccucuacgauuuccuucuuguugauuuucgaaccaggccugucugccucacguagcac

SEQ ID NO: 1347 - RNA, 352 nt, artificial sequence
  synthetic construct
guucuuccuuaacucuaucuuucuuaagaggucccauaaacgcagccuugucggcggcgguuuggaaucuaccguguccgaauuuggacgacguaucgaugaauuucaaauugaucuucuccaaagcaauacgcuuagugugaaccaagagagauuuucucaguguaaugacacgcuucuuaggucccauacaacaacccuuaaucaugacgaagucauuguuaacuucaccauaaugagggaaaccacccauugguguaauggucuucucacuaagaucguaaucgguagcagcauuguuuuugaugaccuuuccguccuuagugugaauuccagcaccgauucuguagac

SEQ ID NO: 1348 - RNA, 319 nt, artificial sequence
  synthetic construct
guacaucccuccacggagacgaaguacuaaauguagaguagauucuuuuugaauauuguagucagauaagguucuuccaucuuccaguuguuugccagcgaaaauuaaacguugcugaucuggaggaauacccucuuugucuuggauuuucgccuucacguucucaauaguaucagaugguucaacuucgagggugauaguuuuaccaguaaggguuuuaacgaauauuugcaucccaccacggagacgaagaacuaagugcaauguggacucuuucugaauguuguagucagacaagguucuuccaucuuccaguugc

SEQ ID NO: 1349 - RNA, 256 nt, artificial sequence
  synthetic construct
guagaaguuuuuggcuaggauuccaucuuucuucguuaaccucacaauacaaucguccgauucucccauacgccugauagcuccgcagagagcguagcucuuggaacuuucggucauucuuccgguuaaaggaucaacgucggcgacgcugaguugaaugcuagcgugguccuuagcaugaauaauucuguugcuagcagagcauuuucuugggcaguacaagucgacgguuucaccagcgucguuuuccauguuc

SEQ ID NO: 1350 - RNA, 351 nt, artificial sequence
  synthetic construct
gcguucccuguucaugaucguaccgacacgacccaaauuucuaccuccggugaucauacacaaguuguuggauucaaacuugauguaaucgagaauuuuagacguagcgaucuccaauugaauugugucguuuaccuugaugacaggaucaggguaacggauuguacgaccaucgugggucaccaaaaacggaauuccuuugggaccgguuugaacccucuuaacuuugcaaagcuuguauuuagcuucuucagcaguaauacgguggauagcaaaucuuccuuucacaucauagaugagacggaaaaauucaccaguuuuuucaauggugauaacauccauaaaaccugc

SEQ ID NO: 1351 - RNA, 352 nt, artificial sequence
  synthetic construct
gcaauuacgaauacauuauuuaaccuaguagcaaaggcaugaccguuagcauccuuaauauguacaauaucgaaggauccaggaugacguucccuguucaugaucguaccgacacgacccaaauuucuaccuccggugaucauacacaaguuguuggauucaaacuugauguaaucgagaauuuuagacguagcgaucuccaauugaauugugucguuuaccuugaugacaggaucaggguaacggauuguacgaccaucgugggucaccaaaaacggaauuccuuugggaccgguuugaacccucuuaacuuugcaaagcuuguauuuagcuucuucagcaguaauacggc

SEQ ID NO: 1352 - RNA, 352 nt, artificial sequence
  synthetic construct
gacaucauagaugagacggaaaaauucaccaguuuuuucaauggugauaacauccauaaaaccugcgggguaguuggagucgguccugacuuuuccaucgacuuugauuaaucuuugcauaacuauuuuaguuaccucgcuguuagugagagcauacuucagccuguuucuuaagaaaaucaccaaggguaaugauucucggaguuugugaggaccgguggacgggcggggugcgaauacaccucccaauuuguccaacauccaugcuuucggcgcauuuaaacgcuucaagugcuuuuuagguccccgagccaucuugacuuuaaaaauaugaaagacagagcaggcgugc

SEQ ID NO: 1353 - RNA, 351 nt, artificial sequence
  synthetic construct
gaugaccguuagcauccuuaauauguacaauaucgaaggauccaggaugacguucccuguucaugaucguaccgacacgacccaaauuucuaccuccggugaucauacacaaguuguuggauucaaacuugauguaaucgagaauuuuagacguagcgaucuccaauugaauugugucguuuaccuugaugacaggaucaggguaacggauuguacgaccaucgugggucaccaaaaacggaauuccuuugggaccgguuugaacccucuuaacuuugcaaagcuuguauuuagcuucuucagcaguaauacgguggauagcaaaucuuccuuucacaucauagaugagac

SEQ ID NO: 1354 - RNA, 351 nt, artificial sequence
  synthetic construct
guaguguguuuuugcagcuagccuuuuaucccuuucuucggcaauggauagcuucacaccuuuaccucuuggaagagacacaaaagccuuagcuccuuuaccaauuacgaauacauuauuuaaccuaguagcaaaggcaugaccguuagcauccuuaauauguacaauaucgaaggauccaggaugacguucccuguucaugaucguaccgacacgacccaaauuucuaccuccggugaucauacacaaguuguuggauucaaacuugauguaaucgagaauuuuagacguagcgaucuccaauugaauugugucguuuaccuugaugacaggaucaggguaacggauugc

SEQ ID NO: 1355 - RNA, 351 nt, artificial sequence
  synthetic construct
guucacaucauagaugagacggaaaaauucaccaguuuuuucaauggugauaacauccauaaaaccugcgggguaguuggagucgguccugacuuuuccaucgacuuugauuaaucuuugcauaacuauuuuaguuaccucgcuguuagugagagcauacuucagccuguuucuuaagaaaaucaccaaggguaaugauucucggaguuugugaggaccgguggacgggcggggugcgaauacaccucccaauuuguccaacauccaugcuuucggcgcauuuaaacgcuucaagugcuuuuuagguccccgagccaucuugacuuuaaaaauaugaaagacagagcaggc

SEQ ID NO: 1356 - RNA, 350 nt, artificial sequence
  synthetic construct
gauccaggaugacguucccuguucaugaucguaccgacacgacccaaauuucuaccuccggugaucauacacaaguuguuggauucaaacuugauguaaucgagaauuuuagacguagcgaucuccaauugaauugugucguuuaccuugaugacaggaucaggguaacggauuguacgaccaucgugggucaccaaaaacggaauuccuuugggaccgguuugaacccucuuaacuuugcaaagcuuguauuuagcuucuucagcaguaauacgguggauagcaaaucuuccuuucacaucauagaugagacggaaaaauucaccaguuuuuucaauggugauaacauc

SEQ ID NO: 1357 - RNA, 350 nt, artificial sequence
  synthetic construct
guuccuuuucaucaucgcccuuuggaccgaaugcugcuacagguuccaccaauucuucuucgccagguuucaaauugcgaaccaugauaaucccuccgauagaaacauccuucauugcaacguauugcgaguuaucauuaagcguaaucacuuucaguuguugccucaugguccuggcaggauuuugcaagauuucgaaacuaggcucgggcuccuuuuucuucuccuccuuaucaucuuucuuaucuuuuuugucgucgcucgacgacgccgcuuuuuuaucgucgguuuucuuaucaucggacuuuuucuccucuuucuugucuucgguuuucuucucuuucuccucc

SEQ ID NO: 1358 - RNA, 351 nt, artificial sequence
  synthetic construct
gcagguuccaccaauucuucuucgccagguuucaaauugcgaaccaugauaaucccuccgauagaaacauccuucauugcaacguauugcgaguuaucauuaagcguaaucacuuucaguuguugccucaugguccuggcaggauuuugcaagauuucgaaacuaggcucgggcuccuuuuucuucuccuccuuaucaucuuucuuaucuuuuuugucgucgcucgacgacgccgcuuuuuuaucgucgguuuucuuaucaucggacuuuuucuccucuuucuugucuucgguuuucuucucuuucuccuccuuuucgguuuucuuaucgucuuuaucuucguccacaucc

SEQ ID NO: 1359 - RNA, 350 nt, artificial sequence
  synthetic construct
gcugcuacagguuccaccaauucuucuucgccagguuucaaauugcgaaccaugauaaucccuccgauagaaacauccuucauugcaacguauugcgaguuaucauuaagcguaaucacuuucaguuguugccucaugguccuggcaggauuuugcaagauuucgaaacuaggcucgggcuccuuuuucuucuccuccuuaucaucuuucuuaucuuuuuugucgucgcucgacgacgccgcuuuuuuaucgucgguuuucuuaucaucggacuuuuucuccucuuucuugucuucgguuuucuucucuuucuccuccuuuucgguuuucuuaucgucuuuaucuucguc

SEQ ID NO: 1360 - RNA, 351 nt, artificial sequence
  synthetic construct
gccgaaugcugcuacagguuccaccaauucuucuucgccagguuucaaauugcgaaccaugauaaucccuccgauagaaacauccuucauugcaacguauugcgaguuaucauuaagcguaaucacuuucaguuguugccucaugguccuggcaggauuuugcaagauuucgaaacuaggcucgggcuccuuuuucuucuccuccuuaucaucuuucuuaucuuuuuugucgucgcucgacgacgccgcuuuuuuaucgucgguuuucuuaucaucggacuuuuucuccucuuucuugucuucgguuuucuucucuuucuccuccuuuucgguuuucuuaucgucuuuauc

SEQ ID NO: 1361 - RNA, 350 nt, artificial sequence
  synthetic construct
gguuccuuuucaucaucgcccuuuggaccgaaugcugcuacagguuccaccaauucuucuucgccagguuucaaauugcgaaccaugauaaucccuccgauagaaacauccuucauugcaacguauugcgaguuaucauuaagcguaaucacuuucaguuguugccucaugguccuggcaggauuuugcaagauuucgaaacuaggcucgggcuccuuuuucuucuccuccuuaucaucuuucuuaucuuuuuugucgucgcucgacgacgccgcuuuuuuaucgucgguuuucuuaucaucggacuuuuucuccucuuucuugucuucgguuuucuucucuuucuccuc

SEQ ID NO: 1362 - RNA, 351 nt, artificial sequence
  synthetic construct
gcugcuacagguuccaccaauucuucuucgccagguuucaaauugcgaaccaugauaaucccuccgauagaaacauccuucauugcaacguauugcgaguuaucauuaagcguaaucacuuucaguuguugccucaugguccuggcaggauuuugcaagauuucgaaacuaggcucgggcuccuuuuucuucuccuccuuaucaucuuucuuaucuuuuuugucgucgcucgacgacgccgcuuuuuuaucgucgguuuucuuaucaucggacuuuuucuccucuuucuugucuucgguuuucuucucuuucuccuccuuuucgguuuucuuaucgucuuuaucuucgucc

SEQ ID NO: 1363 - RNA, 352 nt, artificial sequence
  synthetic construct
gugcugcuacagguuccaccaauucuucuucgccagguuucaaauugcgaaccaugauaaucccuccgauagaaacauccuucauugcaacguauugcgaguuaucauuaagcguaaucacuuucaguuguugccucaugguccuggcaggauuuugcaagauuucgaaacuaggcucgggcuccuuuuucuucuccuccuuaucaucuuucuuaucuuuuuugucgucgcucgacgacgccgcuuuuuuaucgucgguuuucuuaucaucggacuuuuucuccucuuucuugucuucgguuuucuucucuuucuccuccuuuucgguuuucuuaucgucuuuaucuucguc

SEQ ID NO: 1364 - RNA, 351 nt, artificial sequence
  synthetic construct
guagaaacauccuucauugcaacguauugcgaguuaucauuaagcguaaucacuuucaguuguugccucaugguccuggcaggauuuugcaagauuucgaaacuaggcucgggcuccuuuuucuucuccuccuuaucaucuuucuuaucuuuuuugucgucgcucgacgacgccgcuuuuuuaucgucgguuuucuuaucaucggacuuuuucuccucuuucuugucuucgguuuucuucucuuucuccuccuuuucgguuuucuuaucgucuuuaucuucguccacauccauuuucucaucgcgauguuuccucucgugaucccuucuccuuugccucgcagcuaugcuc

SEQ ID NO: 1365 - RNA, 351 nt, artificial sequence
  synthetic construct
gaaugcugcuacagguuccaccaauucuucuucgccagguuucaaauugcgaaccaugauaaucccuccgauagaaacauccuucauugcaacguauugcgaguuaucauuaagcguaaucacuuucaguuguugccucaugguccuggcaggauuuugcaagauuucgaaacuaggcucgggcuccuuuuucuucuccuccuuaucaucuuucuuaucuuuuuugucgucgcucgacgacgccgcuuuuuuaucgucgguuuucuuaucaucggacuuuuucuccucuuucuugucuucgguuuucuucucuuucuccuccuuuucgguuuucuuaucgucuuuaucuuc

SEQ ID NO: 1366 - RNA, 352 nt, artificial sequence
  synthetic construct
guaucauuaagcguaaucacuuucaguuguugccucaugguccuggcaggauuuugcaagauuucgaaacuaggcucgggcuccuuuuucuucuccuccuuaucaucuuucuuaucuuuuuugucgucgcucgacgacgccgcuuuuuuaucgucgguuuucuuaucaucggacuuuuucuccucuuucuugucuucgguuuucuucucuuucuccuccuuuucgguuuucuuaucgucuuuaucuucguccacauccauuuucucaucgcgauguuuccucucgugaucccuucuccuuugccucgcagcuaugcucaauacggcgguggugacuuucucccuuuccucgc

SEQ ID NO: 1367 - RNA, 351 nt, artificial sequence
  synthetic construct
gcgggcuccuuuuucuucuccuccuuaucaucuuucuuaucuuuuuugucgucgcucgacgacgccgcuuuuuuaucgucgguuuucuuaucaucggacuuuuucuccucuuucuugucuucgguuuucuucucuuucuccuccuuuucgguuuucuuaucgucuuuaucuucguccacauccauuuucucaucgcgauguuuccucucgugaucccuucuccuuugccucgcagcuaugcucaauacggcgguggugacuuucucccuuuccucgcguuucuuuuccuccaugggcgccggguaggcguacaagcucgguuucgcguucgauuugaacuccaauuuaggc

SEQ ID NO: 1368 - RNA, 352 nt, artificial sequence
  synthetic construct
guuuaaucgacauauucuucucugaauccuucugcaugaccuuggccacagccauuucgaaaucuucuuggguuacguguacccuucucucccuuagggcguacaugccugccucaguacacacucccuucacuucggcaccgcuggcaccuggcaucaauucggcgauuuuccucaaauugaucccucuggucaaauucauuuuucucgagugaauuuucaagauguccaaucgggcuuccucguucgguggagggaacucgaucuuccugucaauucugccgggccugaguaaagcgggauccaaaaugucgauucuguuuguagccauuauaacuuuaauguucuucgc

SEQ ID NO: 1369 - RNA, 351 nt, artificial sequence
  synthetic construct
gucgaucuuccugucaauucugccgggccugaguaaagcgggauccaaaaugucgauucuguuuguagccauuauaacuuuaauguucuucguagccucaaauccaucgaguugauucagcaacuccagcauaguucuuugaacuucggaaucgccaccagaaccugauucgauacgagaggauccaauagaaucgauuucauccaugaaaaugaucgaaggggcaugcucccuagccauuacgaacaguucccuuaccauccuagaaccuuccccaaugaauuuuugcaccaacuccgauccugauacucuaauaaacgugcauucuguguggugagcuacagcucuagc

SEQ ID NO: 1370 - RNA, 352 nt, artificial sequence
  synthetic construct
guaaucgacauauucuucucugaauccuucugcaugaccuuggccacagccauuucgaaaucuucuuggguuacguguacccuucucucccuuagggcguacaugccugccucaguacacacucccuucacuucggcaccgcuggcaccuggcaucaauucggcgauuuuccucaaauugaucccucuggucaaauucauuuuucucgagugaauuuucaagauguccaaucgggcuuccucguucgguggagggaacucgaucuuccugucaauucugccgggccugaguaaagcgggauccaaaaugucgauucuguuuguagccauuauaacuuuaauguucuucguac

SEQ ID NO: 1371 - RNA, 350 nt, artificial sequence
  synthetic construct
gccguugaaacuguaacuguacaaaauugguugaaucaugaucaaugauugaguaagaucuucucucaucaacauaugucuauagaacgacguuucaucaggagaauuauugaaaacuugcaagaacugagaccuccuuagaugguacaugaauugcggauagaggcuaaaguuuuggccuaaucugaaugaaccagcaucgucuuuauuguauucuccgaauuuuugacacaaucgaaucagcauucuaucgacccaucucagaacgucgggacucucaucugauucagcucuauaaacagccauucuggccauaauuacagcugcugcuuccugaucaaaaccagcgc

SEQ ID NO: 1372 - RNA, 352 nt, artificial sequence
  synthetic construct
gaucaacauaugucuauagaacgacguuucaucaggagaauuauugaaaacuugcaagaacugagaccuccuuagaugguacaugaauugcggauagaggcuaaaguuuuggccuaaucugaaugaaccagcaucgucuuuauuguauucuccgaauuuuugacacaaucgaaucagcauucuaucgacccaucucagaacgucgggacucucaucugauucagcucuauaaacagccauucuggccauaauuacagcugcugcuuccugaucaaaaccagcgcugaugugguggauauuaguaguggcaucagcccaguuucgagccacuguugucacucuaauucuucuc

SEQ ID NO: 1373 - RNA, 352 nt, artificial sequence
  synthetic construct
guguaacuguacaaaauugguugaaucaugaucaaugauugaguaagaucuucucucaucaacauaugucuauagaacgacguuucaucaggagaauuauugaaaacuugcaagaacugagaccuccuuagaugguacaugaauugcggauagaggcuaaaguuuuggccuaaucugaaugaaccagcaucgucuuuauuguauucuccgaauuuuugacacaaucgaaucagcauucuaucgacccaucucagaacgucgggacucucaucugauucagcucuauaaacagccauucuggccauaauuacagcugcugcuuccugaucaaaaccagcgcugaugugguggc

SEQ ID NO: 1374 - RNA, 352 nt, artificial sequence
  synthetic construct
guugaaacuguaacuguacaaaauugguugaaucaugaucaaugauugaguaagaucuucucucaucaacauaugucuauagaacgacguuucaucaggagaauuauugaaaacuugcaagaacugagaccuccuuagaugguacaugaauugcggauagaggcuaaaguuuuggccuaaucugaaugaaccagcaucgucuuuauuguauucuccgaauuuuugacacaaucgaaucagcauucuaucgacccaucucagaacgucgggacucucaucugauucagcucuauaaacagccauucuggccauaauuacagcugcugcuuccugaucaaaaccagcgcugauc

SEQ ID NO: 1375 - RNA, 351 nt, artificial sequence
  synthetic construct
gugaaucaugaucaaugauugaguaagaucuucucucaucaacauaugucuauagaacgacguuucaucaggagaauuauugaaaacuugcaagaacugagaccuccuuagaugguacaugaauugcggauagaggcuaaaguuuuggccuaaucugaaugaaccagcaucgucuuuauuguauucuccgaauuuuugacacaaucgaaucagcauucuaucgacccaucucagaacgucgggacucucaucugauucagcucuauaaacagccauucuggccauaauuacagcugcugcuuccugaucaaaaccagcgcugaugugguggauauuaguaguggcaucagc

SEQ ID NO: 1376 - RNA, 352 nt, artificial sequence
  synthetic construct
gugucuauagaacgacguuucaucaggagaauuauugaaaacuugcaagaacugagaccuccuuagaugguacaugaauugcggauagaggcuaaaguuuuggccuaaucugaaugaaccagcaucgucuuuauuguauucuccgaauuuuugacacaaucgaaucagcauucuaucgacccaucucagaacgucgggacucucaucugauucagcucuauaaacagccauucuggccauaauuacagcugcugcuuccugaucaaaaccagcgcugaugugguggauauuaguaguggcaucagcccaguuucgagccacuguugucacucuaauucuucuuugaccacuc

SEQ ID NO: 1377 - RNA, 351 nt, artificial sequence
  synthetic construct
gcuuuuuggagagcuucagcugcauucuucauugaaucuaagacggcuguguuggugcuggcuccuucgagggccucccuuugcauuucgauuguagugagugugccaucgauuuguaauugaguuuuuuccaaucguuuuuucuuuuugagcgccugcagcgcgacucucuuauucuuugaugcauuuuuuuuggcuacuaguguauauuccucuauuuucuuuucuaaaaacucuuguuuuuuauauaacauguccucgguuucccugagcuuuuggauggcuucgccuggcguggggcccacauccuuuucuuuuccuccgaauauuuuacuaaagaaacucauuguc

SEQ ID NO: 1378 - RNA, 351 nt, artificial sequence
  synthetic construct
gucaaauucgccagggcguccuccccgaagaucgauuucgcguacauauuggccgccaugaagccgcauugcccgccgagcgccuucucugaugucaggcacuucauguuaguacucuucagcagaugcuccagguacucguugagauccgucagcggcguauugacggucaccuuauucucccauucgaauucagcccacauccucauaaacuccgaaucggugcacgaugccggaacaauguaauccauaauaucgauguguaugucguucaaaacgacuacauuccuguccgaagcggcgccugucacgucguacacgauguuaccgaauaugauaccauucucgguc

SEQ ID NO: 1379 - RNA, 352 nt, artificial sequence
  synthetic construct
gaauaucgauguguaugucguucaaaacgacuacauuccuguccgaagcggcgccugucacgucguacacgauguuaccgaauaugauaccauucucggucgaggccacuuucacguuagccuugauauugcagaaauccuucggcgccagaacgaccggcugaggcuucuccaccaacuucaaaucgcccagagucgccaacuccagaguacaauucugcagcgugucgcucguuugguucaccaccaacacguccagcacgauaucguacugauuaacgugcacauacgcuucggaguaaacaggauccgagaaacccgucaacugggcgaucuuguucaauuuacucgc

SEQ ID NO: 1380 - RNA, 352 nt, artificial sequence
  synthetic construct
gauuucgcguacauauuggccgccaugaagccgcauugcccgccgagcgccuucucugaugucaggcacuucauguuaguacucuucagcagaugcuccagguacucguugagauccgucagcggcguauugacggucaccuuauucucccauucgaauucagcccacauccucauaaacuccgaaucggugcacgaugccggaacaauguaauccauaauaucgauguguaugucguucaaaacgacuacauuccuguccgaagcggcgccugucacgucguacacgauguuaccgaauaugauaccauucucggucgaggccacuuucacguuagccuugauauugcagc

SEQ ID NO: 1381 - RNA, 352 nt, artificial sequence
  synthetic construct
gauauuggccgccaugaagccgcauugcccgccgagcgccuucucugaugucaggcacuucauguuaguacucuucagcagaugcuccagguacucguugagauccgucagcggcguauugacggucaccuuauucucccauucgaauucagcccacauccucauaaacuccgaaucggugcacgaugccggaacaauguaauccauaauaucgauguguaugucguucaaaacgacuacauuccuguccgaagcggcgccugucacgucguacacgauguuaccgaauaugauaccauucucggucgaggccacuuucacguuagccuugauauugcagaaauccuucggc

SEQ ID NO: 1382 - RNA, 351 nt, artificial sequence
  synthetic construct
gucgauguguaugucguucaaaacgacuacauuccuguccgaagcggcgccugucacgucguacacgauguuaccgaauaugauaccauucucggucgaggccacuuucacguuagccuugauauugcagaaauccuucggcgccagaacgaccggcugaggcuucuccaccaacuucaaaucgcccagagucgccaacuccagaguacaauucugcagcgugucgcucguuugguucaccaccaacacguccagcacgauaucguacugauuaacgugcacauacgcuucggaguaaacaggauccgagaaacccgucaacugggcgaucuuguucaauuuacucgagcc

SEQ ID NO: 1383 - RNA, 352 nt, artificial sequence
  synthetic construct
guauucucccauucgaauucagcccacauccucauaaacuccgaaucggugcacgaugccggaacaauguaauccauaauaucgauguguaugucguucaaaacgacuacauuccuguccgaagcggcgccugucacgucguacacgauguuaccgaauaugauaccauucucggucgaggccacuuucacguuagccuugauauugcagaaauccuucggcgccagaacgaccggcugaggcuucuccaccaacuucaaaucgcccagagucgccaacuccagaguacaauucugcagcgugucgcucguuugguucaccaccaacacguccagcacgauaucguacugac

SEQ ID NO: 1384 - RNA, 351 nt, artificial sequence
  synthetic construct
guccgguaugugcaaggcugguuucgccggagacgacgccccgcgcgccgucuuccccucgaucgucggucgcccaagacaucagggugugauggucgguaugggacaaaaggacuccuacguaggagacgaggcccaaagcaaaagagguauccucacuuugaaauaccccaucgaacacgguaucaucaccaacugggaugacauggaaaagaucuggcaccacaccuucuacaacgaacuccgugucgcuccggaagaacaccccguccucuugaccgaggcuccucuuaacccuaaagccaacagggaaaagaugacccaaaucauguuugaaaccuucaacacacc

SEQ ID NO: 1385 - RNA, 351 nt, artificial sequence
  synthetic construct
gauccgguaugugcaaggcugguuucgccggagacgacgccccgcgcgccgucuuccccucgaucgucggucgcccaagacaucagggugugauggucgguaugggacaaaaggacuccuacguaggagacgaggcccaaagcaaaagagguauccucacuuugaaauaccccaucgaacacgguaucaucaccaacugggaugacauggaaaagaucuggcaccacaccuucuacaacgaacuccgugucgcuccggaagaacaccccguccucuugaccgaggcuccucuuaacccuaaagccaacagggaaaagaugacccaaaucauguuugaaaccuucaacacac

SEQ ID NO: 1386 - RNA, 351 nt, artificial sequence
  synthetic construct
gucuuggguauggaauccugcgguauccacgaaaccguauacaacuccaucaugaagugcgacgucgacauccguaaggacuuguacgccaacacuguacucuccggugguaccaccauguacccugguauugcugaccguaugcaaaaggaaaucaccgcucuugcccccagcacaaucaagaucaagaucauugcucccccagaaaggaaauacuccguauggaucgguggauccaucuuggcuucucuuuccacuuuccaacagauguggaucuccaaacaggaauacgacgaauccggcccuggaaucguucaccgcaagugcuucuaagcuauuuacuacucuuac

SEQ ID NO: 1387 - RNA, 352 nt, artificial sequence
  synthetic construct
guucuacaacgaacuccgugucgcuccggaagaacaccccguccucuugaccgaggcuccucuuaacccuaaagccaacagggaaaagaugacccaaaucauguuugaaaccuucaacacaccggccauguacgucgccauccaagccguacucucccucuacgcuuccggucguaccaccgguauuguauuggacuccggugacgguguaacccacaccguaccgaucuacgaagguuacgcucuuccccacgccauccuccguuuggacuuggccggucgcgauuugaccgacuaccucaugaaaauccucaccgaaagggguuacucguucaccaccaccgcugaaagc

SEQ ID NO: 1388 - RNA, 352 nt, artificial sequence
  synthetic construct
guuccaaccuuccuucuuggguauggaauccugcgguauccacgaaaccguauacaacuccaucaugaagugcgacgucgacauccguaaggacuuguacgccaacacuguacucuccggugguaccaccauguacccugguauugcugaccguaugcaaaaggaaaucaccgcucuugcccccagcacaaucaagaucaagaucauugcucccccagaaaggaaauacuccguauggaucgguggauccaucuuggcuucucuuuccacuuuccaacagauguggaucuccaaacaggaauacgacgaauccggcccuggaaucguucaccgcaagugcuucuaagcuauc

SEQ ID NO: 1389 - RNA, 352 nt, artificial sequence
  synthetic construct
guauccucacuuugaaauaccccaucgaacacgguaucaucaccaacugggaugacauggaaaagaucuggcaccacaccuucuacaacgaacuccgugucgcuccggaagaacaccccguccucuugaccgaggcuccucuuaacccuaaagccaacagggaaaagaugacccaaaucauguuugaaaccuucaacacaccggccauguacgucgccauccaagccguacucucccucuacgcuuccggucguaccaccgguauuguauuggacuccggugacgguguaacccacaccguaccgaucuacgaagguuacgcucuuccccacgccauccuccguuuggacuc

SEQ ID NO: 1390 - RNA, 352 nt, artificial sequence
  synthetic construct
gagaaacucugcuaugucgcccucgacuucgaacaggaaauggccaccgccgccgccuccaccucccucgaaaagagcuacgaacuucccgacggucaagucaucaccaucgguaacgaaagauuccguugcccugaggcucucuuccaaccuuccuucuuggguauggaauccugcgguauccacgaaaccguauacaacuccaucaugaagugcgacgucgacauccguaaggacuuguacgccaacacuguacucuccggugguaccaccauguacccugguauugcugaccguaugcaaaaggaaaucaccgcucuugcccccagcacaaucaagaucaagaucauuc

SEQ ID NO: 1391 - RNA, 352 nt, artificial sequence
  synthetic construct
gaaaagagcuacgaacuucccgacggucaagucaucaccaucgguaacgaaagauuccguugcccugaggcucucuuccaaccuuccuucuuggguauggaauccugcgguauccacgaaaccguauacaacuccaucaugaagugcgacgucgacauccguaaggacuuguacgccaacacuguacucuccggugguaccaccauguacccugguauugcugaccguaugcaaaaggaaaucaccgcucuugcccccagcacaaucaagaucaagaucauugcucccccagaaaggaaauacuccguauggaucgguggauccaucuuggcuucucuuuccacuuuccaac

SEQ ID NO: 1392 - RNA, 335 nt, artificial sequence
  synthetic construct
guuuacaauucuuuuucaaucuuaaugauuucuuggaugccaucguacaucuccuuaacggcaucgaacuccgugagacccaugcgucucuuguuggagaugucguagacaccgccuucggccucgguguguucaccgcgaguaccgcgcaccugcaaguuguacuuggcagcgaccuccuccagcuuggccuuguuggcagccaacuugggcaccuugauauggaccgaagcgcggacagugguacccaaguuagucgggcagaaggucaggaaaccgagccugucguugugggagaacggaagucucuuuucgaugucguugacggcgguuac

SEQ ID NO: 1393 - RNA, 283 nt, artificial sequence
  synthetic construct
gggcgggugcuugucggucuucuugaagccgccgugguaguccucgaugaugggaucgaagauguccgcgaauacgguguacgauucagcgucgggggcguagauuccuacgccggagucgugguucuccaagccggauuggaugacaucaagaagagucgagccgaaagugggggucuucuuggucuucaaguugucgaagaucuccugggugaggugcuucuucagcagcgauuuggagucggaguccuugauuuucuugaaaccggauucaaguuugucc

SEQ ID NO: 1394 - RNA, 135 nt, artificial sequence
  synthetic construct
gauuaaaggaaggaauggaugaaacgaugcccaguucacuccgcgaucguguccuuccaaaacgugcuucaccacagcaucggcuuggccaaauagcucgguggcucccggauuuuugagguggucuucgaggcc

SEQ ID NO: 1395 - RNA, 135 nt, artificial sequence; identical to SEQ ID NO: 1394
  synthetic construct

SEQ ID NO: 1396 - RNA, 153 nt, artificial sequence
  synthetic construct
guaagcugucuugaaauccuuuucaucggcugcgugcagcacgcccgauugcagaucgagggcggccugcaucuuuggagggcaauaaauagcguuagcggucguucuagcggaaguuagagcggcucgagcuuuggguaaauugcugagagc

SEQ ID NO: 1397 - RNA, 158 nt, artificial sequence
  synthetic construct
guaaaaauaggaguaagcugucuugaaauccuuuucaucggcugcgugcagcacgcccgauugcagaucgagggcggccugcaucuuuggagggcaauaaauagcguuagcggucguucuagcggaaguuagagcggcucgagcuuuggguaaauugc

SEQ ID NO: 1398 - RNA, 149 nt, artificial sequence
  synthetic construct
gcauguacuuaagagcagucagagcuuugggagauucgacgcuaucgaacccuucgaaggcuucguaaaaauaggaguaagcugucuugaaauccuuuucaucggcugcgugcagcacgcccgauugcagaucgagggcggccugcauc

SEQ ID NO: 1399 - RNA, 157 nt, artificial sequence
  synthetic construct
gaagacucaucacgaucagccuuaacuugcauaccaccaguaacacgagagaugguuucacgaccagagagaucgguaacgugaacgaaaguaucguugaaagaagcaaagaugugggcaacaccgaaaacgaguucaccuucacgaacuugaggac

SEQ ID NO: 1400 - RNA, 159 nt, artificial sequence
  synthetic construct
ggcagcaacuuguugggcagccaacauagcagcauaaggagaagacucaucacgaucagccuuaacuugcauaccaccaguaacacgagagaugguuucacgaccagagagaucgguaacgugaacgaaaguaucguugaaagaagcaaagaugugggc

SEQ ID NO: 1401 - RNA, 150 nt, artificial sequence
  synthetic construct
gccuuaacuugcauaccaccaguaacacgagagaugguuucacgaccagagagaucgguaacgugaacgaaaguaucguugaaagaagcaaagaugugggcaacaccgaaaacgaguucaccuucacgaacuugaggaccgagagugacc

SEQ ID NO: 1402 - RNA, 155 nt, artificial sequence
  synthetic construct
gcaacuuguugggcagccaacauagcagcauaaggagaagacucaucacgaucagccuuaacuugcauaccaccaguaacacgagagaugguuucacgaccagagagaucgguaacgugaacgaaaguaucguugaaagaagcaaagaugugggc

SEQ ID NO: 1403 - RNA, 144 nt, artificial sequence
  synthetic construct
ggaaggaauggaugaaacgaugcccaguucacuccgcgaucguguccuuccaaaacgugcuucaccacagcaucggcuuggccaaauagcucgguggcucccggauuuuugagguggucuucgaggcccgugggguguggugcc

SEQ ID NO: 1404 - RNA, 153 nt, artificial sequence
  synthetic construct
guggauggggaacaggaucaacuuggauuuguauucuuucaaacguugagcguuuaguugaauggauucuacggacuuguuccuccuccuguggucgacggcgacgccgacgguccuggcgaaucucggguuaagucccgcggcuuuuaauuc

SEQ ID NO: 1405 - RNA, 166 nt, artificial sequence
  synthetic construct
guauucuuucaaacguugagcguuuaguugaauggauucuacggacuuguuccuccuccuguggucgacggcgacgccgacgguccuggcgaaucucggguuaagucccgcggcuuuuaauucuugcagggugaauccgcguccggcgcguauuuuggugugguac

SEQ ID NO: 1406 - RNA, 154 nt, artificial sequence
  synthetic construct
gauuuguauucuuucaaacguugagcguuuaguugaauggauucuacggacuuguuccuccuccuguggucgacggcgacgccgacgguccuggcgaaucucggguuaagucccgcggcuuuuaauucuugcagggugaauccgcguccggcgc

SEQ ID NO: 1407 - RNA, 147 nt, artificial sequence
  synthetic construct
guaugauuagccaacauaagaccugagacucggugagcggacugaauguaaggagacuuccucgauagagccaccuguauacuagccgggccccaagggaugaacugggcgaguuugcguucgcguauccuuugcaacgauuuaugc

SEQ ID NO: 1408 - RNA, 153 nt, artificial sequence
  synthetic construct
gccaacauaagaccugagacucggugagcggacugaauguaaggagacuuccucgauagagccaccuguauacuagccgggccccaagggaugaacugggcgaguuugcguucgcguauccuuugcaacgauuuaugcacuugaguagcaucc

SEQ ID NO: 1409 - RNA, 157 nt, artificial sequence
  synthetic construct
gauuagccaacauaagaccugagacucggugagcggacugaauguaaggagacuuccucgauagagccaccuguauacuagccgggccccaagggaugaacugggcgaguuugcguucgcguauccuuugcaacgauuuaugcacuugaguagcauc

SEQ ID NO: 1410 - RNA, 158 nt, artificial sequence
  synthetic construct
guaugauuagccaacauaagaccugagacucggugagcggacugaauguaaggagacuuccucgauagagccaccuguauacuagccgggccccaagggaugaacugggcgaguuugcguucgcguauccuuugcaacgauuuaugcacuugaguagc

SEQ ID NO: 1411 - RNA, 256 nt, artificial sequence
  synthetic construct
guaaaaguuuuuagcuaagauuccaucuuucuucguuagccucacaaugcaaucaucugauucacccauucuccuaauagcuccacaaagagcauagcuuuucgaguucucggucauucuaccaguugcugggucaacaucagcuaugcuaaguuggaugcuagcaugguccuuagcauggauaauucuguuacuggcagaacauuuucuugggcaguacaaaucaacgguuucuccugcgucguuuuccauuauc

SEQ ID NO: 1412 - RNA, 352 nt, artificial sequence
  synthetic construct
gaggagugcaucuaauucuuguuugcuuucuacgaaucuugaccugucauuagcaucaauaagaaacacuauugcaucuacagcuggaaaauaguccuuccauacccuucuagcuugagagugacccccuaagucaaaaguaguaaaccucauacuaccaauagacaauucuucagaugucggauguaacguaggcaaaugcugggcuagucuaucgucuuuuaacauguguaaaagggugguuuuaccagcauuaucaaguccuaaaaagagcagcuuaccagauuucuuccauagaccuaaauauccgagcacuccugugaaccagucccauaugaacauuuugacuaac

SEQ ID NO: 1413 - RNA, 352 nt, artificial sequence
  synthetic construct
guauaaagcauaaaaauuucguaguucgucuucagaggcugcaccuggcaggucaauuuuauugccuaaaauuaggacaggacaguuugcuagaguuucaucuguuaggagugcaucuaauucuuguuugcuuucuacgaaucuugaccugucauuagcaucaauaagaaacacuauugcaucuacagcuggaaaauaguccuuccauacccuucuagcuugagagugacccccuaagucaaaaguaguaaaccucauacuaccaauagacaauucuucagaugucggauguaacguaggcaaaugcugggcuagucuaucgucuuuuaacauguguaaaagggugguuuuc

SEQ ID NO: 1414 - RNA, 350 nt, artificial sequence
  synthetic construct
gccuaaaauuaggacaggacaguuugcuagaguuucaucuguuaggagugcaucuaauucuuguuugcuuucuacgaaucuugaccugucauuagcaucaauaagaaacacuauugcaucuacagcuggaaaauaguccuuccauacccuucuagcuugagagugacccccuaagucaaaaguaguaaaccucauacuaccaauagacaauucuucagaugucggauguaacguaggcaaaugcugggcuagucuaucgucuuuuaacauguguaaaagggugguuuuaccagcauuaucaaguccuaaaaagagcagcuuaccagauuucuuccauagaccuaaauauc

SEQ ID NO: 1415 - RNA, 352 nt, artificial sequence
  synthetic construct
guuucguaguucgucuucagaggcugcaccuggcaggucaauuuuauugccuaaaauuaggacaggacaguuugcuagaguuucaucuguuaggagugcaucuaauucuuguuugcuuucuacgaaucuugaccugucauuagcaucaauaagaaacacuauugcaucuacagcuggaaaauaguccuuccauacccuucuagcuugagagugacccccuaagucaaaaguaguaaaccucauacuaccaauagacaauucuucagaugucggauguaacguaggcaaaugcugggcuagucuaucgucuuuuaacauguguaaaagggugguuuuaccagcauuaucaagc

SEQ ID NO: 1416 - RNA, 351 nt, artificial sequence
  synthetic construct
gaaauuaggacaggacaguuugcuagaguuucaucuguuaggagugcaucuaauucuuguuugcuuucuacgaaucuugaccugucauuagcaucaauaagaaacacuauugcaucuacagcuggaaaauaguccuuccauacccuucuagcuugagagugacccccuaagucaaaaguaguaaaccucauacuaccaauagacaauucuucagaugucggauguaacguaggcaaaugcugggcuagucuaucgucuuuuaacauguguaaaagggugguuuuaccagcauuaucaaguccuaaaaagagcagcuuaccagauuucuuccauagaccuaaauauccgagc

SEQ ID NO: 1417 - RNA, 351 nt, artificial sequence
  synthetic construct
guuucaucuguuaggagugcaucuaauucuuguuugcuuucuacgaaucuugaccugucauuagcaucaauaagaaacacuauugcaucuacagcuggaaaauaguccuuccauacccuucuagcuugagagugacccccuaagucaaaaguaguaaaccucauacuaccaauagacaauucuucagaugucggauguaacguaggcaaaugcugggcuagucuaucgucuuuuaacauguguaaaagggugguuuuaccagcauuaucaaguccuaaaaagagcagcuuaccagauuucuuccauagaccuaaauauccgagcacuccugugaaccagucccauaugaac

SEQ ID NO: 1418 - RNA, 351 nt, artificial sequence
  synthetic construct
guaauuucuuuaauaacagcuucaaugucugagacagaaguggcauauucucccaauauccaaagagcugcucuaugcacuuuaacagauuuuauaucuuugaauguuucuagaaguuucucaauaauaagugguugcagauuaucaaacuucuguauggccucucucaaaaauaguaacacgucaguagcagcuaacucguuacuaucagacaaaaauuccauuaaaacaggaaugacaguuacagcuacaucugggaauuuuauacaacaagaaugaaguguucuaacaaguaacugccuguauuuuccuguaucuucgugcucgcuaucuacgguuuuugauaccucc

SEQ ID NO: 1419 - RNA, 352 nt, artificial sequence
  synthetic construct
guuucuaugcucaaauuugcaagcgcgucuucuccgaaaauagauuuggcauacauauuggcggccauaaauccgcauugaccgcuaagggcuuuuucggaagucagacauuucauguuuguacuuuucaagagauggucaagguaaucggcgaggucugugagagguguauuuacagugaccuuauuuucccauucaaauucugcccacauccucauaaacucgguaucuguacagcucgcgggaacaauauaauccauaauaucgauaugaaugucguuuaaaaccacuacauuucuaucugaagcggcaccggugacgucguaaacaauauuaccaaauauaaugccgc

SEQ ID NO: 1420 - RNA, 351 nt, artificial sequence
  synthetic construct
gucgccgcucuuguccgcuucuaauugaaggaaacugauagcgucaucuguuuggauagugugucuggauuguucuuucgauuuuugagucguggcuucuuccguuuccuucgcuaucaacaugucauugagagcagaucgacacagaguagagaaaauuuguauuauugggucggugcggucugagaugacacgcaagcaaaaaaguauguggucuuugucaucguugguuauugguuuugucgguaaaccugauuugccuaaauguaugauaccugccauaauaagcaugacuucagcaucaaaccuauuucuaucagcagcugaggcaauuugaccauaucuuaaagc

SEQ ID NO: 1421 - RNA, 351 nt, artificial sequence
  synthetic construct
gaguguuacaaguguaccagcagcuucauaucugacagcaggacugcuugaauuuaauagauuguaaaugcagcggauaaaucuugaccucucugugggauuugaauggcaaacuuuauagauuaauucaacaaugaccaauugcagaaugucuccaaaugauguaacuugaucuagacaauuugccaaauaagacagugcucuaucuugaucagcauguaaaagcaucagaaaagcauuucucuugcaagacauauccugcucaccaucuaaauaaguagaaauaaguucgggugcaucaggaauuaagaacucaaaauuucuauaaauuguaaaaauagccaaaacugc

SEQ ID NO: 1422 - RNA, 351 nt, artificial sequence
  synthetic construct
guuuaauagauuguaaaugcagcggauaaaucuugaccucucugugggauuugaauggcaaacuuuauagauuaauucaacaaugaccaauugcagaaugucuccaaaugauguaacuugaucuagacaauuugccaaauaagacagugcucuaucuugaucagcauguaaaagcaucagaaaagcauuucucuugcaagacauauccugcucaccaucuaaauaaguagaaauaaguucgggugcaucaggaauuaagaacucaaaauuucuauaaauuguaaaaauagccaaaacugcauuucuucgcacauaacugugccugugauccaaacaggcucugauacuagc

SEQ ID NO: 1423 - RNA, 352 nt, artificial sequence
  synthetic construct
guuauacaacaagaaugaaguguucuaacaaguaacugccuguauuuuccuguaucuucgugcucgcuaucuacgguuuuugauaccuccuuuuuaagaaccaaaaccauuucuucuauauuacgagaugauaccaguucaagugcuagguuuaaagucuuuuugcgaacuuccaagucaggagcuugcaacacucuuaauauauccauaaccaaaucuugcaaaacccuuucauggcugggauguuccuuaagggcaaucaaucuguccaagacaaucaacuuuacauuauuaucacuuuccuugauaauuaguucaauauaacaacuagcagcugcuuuuacugcugugc

SEQ ID NO: 1424 - RNA, 350 nt, artificial sequence
  synthetic construct
gcacuugaaaguguuacaaguguaccagcagcuucauaucugacagcaggacugcuugaauuuaauagauuguaaaugcagcggauaaaucuugaccucucugugggauuugaauggcaaacuuuauagauuaauucaacaaugaccaauugcagaaugucuccaaaugauguaacuugaucuagacaauuugccaaauaagacagugcucuaucuugaucagcauguaaaagcaucagaaaagcauuucucuugcaagacauauccugcucaccaucuaaauaaguagaaauaaguucgggugcaucaggaauuaagaacucaaaauuucuauaaauuguaaaaauagc

SEQ ID NO: 1425 - RNA, 352 nt, artificial sequence
  synthetic construct
guaucaacaugucauugagagcagaucgacacagaguagagaaaauuuguauuauugggucggugcggucugagaugacacgcaagcaaaaaaguauguggucuuugucaucguugguuauugguuuugucgguaaaccugauuugccuaaauguaugauaccugccauaauaagcaugacuucagcaucaaaccuauuucuaucagcagcugaggcaauuugaccauaucuuaaagcuaauuugguuagaguagaagccaaggacgcuccuauaaaaaaaucaccauccauaagauauugccucagaggaggucguuuuucuuuugaagauuuacugacugaauuaaaggc

SEQ ID NO: 1426 - RNA, 352 nt, artificial sequence
  synthetic construct
guaucaccuaaacucaaagccauuccuugacuuuuagcucuaauccugaugugcccugcgacuggugcaucugguuuguugaaaggcuuuucuaugcucaaauuugcaagcgcgucuucuccgaaaauagauuuggcauacauauuggcggccauaaauccgcauugaccgcuaagggcuuuuucggaagucagacauuucauguuuguacuuuucaagagauggucaagguaaucggcgaggucugugagagguguauuuacagugaccuuauuuucccauucaaauucugcccacauccucauaaacucgguaucuguacagcucgcgggaacaauauaauccauaauac

SEQ ID NO: 1427 - RNA, 352 nt, artificial sequence
  synthetic construct
gaauaauuugccaucaggugaaguuuuugguacaauuucccaaaaaauuagaaguaauuucuuagcuaaaugauccugaaggggaaggacauuccuuauaauagucauuaagaauccguuugguaaucuuucuccagcuaauaucauguguauaauccuuucaagugcucuuauuuuuaccuuaaccucgcccuuuucgagguccauuuugagcugcauuucauuguagggcuccgaaucaguugguagauuaauuaaaguauaacaagacuguucaacggcagucauuuuaauuagaacgcgauucuggugaaauaagaauuguagauuuauuuuucgguaguauuuaaac

SEQ ID NO: 1428 - RNA, 350 nt, artificial sequence
  synthetic construct
ggauagugugucuggauuguucuuucgauuuuugagucguggcuucuuccguuuccuucgcuaucaacaugucauugagagcagaucgacacagaguagagaaaauuuguauuauugggucggugcggucugagaugacacgcaagcaaaaaaguauguggucuuugucaucguugguuauugguuuugucgguaaaccugauuugccuaaauguaugauaccugccauaauaagcaugacuucagcaucaaaccuauuucuaucagcagcugaggcaauuugaccauaucuuaaagcuaauuugguuagaguagaagccaaggacgcuccuauaaaaaaaucaccaucc

SEQ ID NO: 1429 - RNA, 350 nt, artificial sequence
  synthetic construct
gauugauacucuuuguccauucacuuuagcaaaaccucucuuguaaauuaauucccuaacagauuucaaauugggguaaccccauguaauguaagguucacauauucuaagcauguuaaugguagcuuuguugaguuuuacaaaaacuccauuguugaucugaaguagacggaaaaguugaagaacuuuacguacuuuuggugcuacuuuauugauacccuuaauacggauaacgaaagccaauuuagccucuccagguacauagaaauuacccuuauuuuuagcuugacgaauuaaccuuauuucaucucguucuuuuaaucuguauuccuuaacauacuguucugcuc

SEQ ID NO: 1430 - RNA, 351 nt, artificial sequence
  synthetic construct
gcaaugaucugauugcuagugauugauacucuuuguccauucacuuuagcaaaaccucucuuguaaauuaauucccuaacagauuucaaauugggguaaccccauguaauguaagguucacauauucuaagcauguuaaugguagcuuuguugaguuuuacaaaaacuccauuguugaucugaaguagacggaaaaguugaagaacuuuacguacuuuuggugcuacuuuauugauacccuuaauacggauaacgaaagccaauuuagccucuccagguacauagaaauuacccuuauuuuuagcuugacgaauuaaccuuauuucaucucguucuuuuaaucuguauucc

SEQ ID NO: 1431 - RNA, 352 nt, artificial sequence
  synthetic construct
guuuuaucuucucuauuaccaaagucaccaccuucuacauagugauuggucuucuuacgccagccaccaguugguguguuuagcuugaagggccauaagaaguuggaggcauauuugaaccuggauccaacagugaacaguucaugaaucaaaucuucaauacagauaaugccagauuuuccuaaucugucuucaaugaucugauugcuagugauugauacucuuuguccauucacuuuagcaaaaccucucuuguaaauuaauucccuaacagauuucaaauugggguaaccccauguaauguaagguucacauauucuaagcauguuaaugguagcuuuguugaguuuuc

SEQ ID NO: 1432 - RNA, 352 nt, artificial sequence
  synthetic construct
guucacauauucuaagcauguuaaugguagcuuuguugaguuuuacaaaaacuccauuguugaucugaaguagacggaaaaguugaagaacuuuacguacuuuuggugcuacuuuauugauacccuuaauacggauaacgaaagccaauuuagccucuccagguacauagaaauuacccuuauuuuuagcuugacgaauuaaccuuauuucaucucguucuuuuaaucuguauuccuuaacauacuguucugcucuuuugaaaauaucuuuucucuuuuugauuuguucagacuucuucuuuacaauggauugaagccuuuuagcccuagaggcuucacgucuuuugcgguc

SEQ ID NO: 1433 - RNA, 352 nt, artificial sequence
  synthetic construct
gauugauacucuuuguccauucacuuuagcaaaaccucucuuguaaauuaauucccuaacagauuucaaauugggguaaccccauguaauguaagguucacauauucuaagcauguuaaugguagcuuuguugaguuuuacaaaaacuccauuguugaucugaaguagacggaaaaguugaagaacuuuacguacuuuuggugcuacuuuauugauacccuuaauacggauaacgaaagccaauuuagccucuccagguacauagaaauuacccuuauuuuuagcuugacgaauuaaccuuauuucaucucguucuuuuaaucuguauuccuuaacauacuguucugcucuc

SEQ ID NO: 1434 - RNA, 352 nt, artificial sequence
  synthetic construct
guaaucugucuucaaugaucugauugcuagugauugauacucuuuguccauucacuuuagcaaaaccucucuuguaaauuaauucccuaacagauuucaaauugggguaaccccauguaauguaagguucacauauucuaagcauguuaaugguagcuuuguugaguuuuacaaaaacuccauuguugaucugaaguagacggaaaaguugaagaacuuuacguacuuuuggugcuacuuuauugauacccuuaauacggauaacgaaagccaauuuagccucuccagguacauagaaauuacccuuauuuuuagcuugacgaauuaaccuuauuucaucucguucuuuuac

SEQ ID NO: 1435 - RNA, 351 nt, artificial sequence
  synthetic construct
gacagauaaugccagauuuuccuaaucugucuucaaugaucugauugcuagugauugauacucuuuguccauucacuuuagcaaaaccucucuuguaaauuaauucccuaacagauuucaaauugggguaaccccauguaauguaagguucacauauucuaagcauguuaaugguagcuuuguugaguuuuacaaaaacuccauuguugaucugaaguagacggaaaaguugaagaacuuuacguacuuuuggugcuacuuuauugauacccuuaauacggauaacgaaagccaauuuagccucuccagguacauagaaauuacccuuauuuuuagcuugacgaauuaacc

SEQ ID NO: 1436 - RNA, 351 nt, artificial sequence
  synthetic construct
guuggaggcauauuugaaccuggauccaacagugaacaguucaugaaucaaaucuucaauacagauaaugccagauuuuccuaaucugucuucaaugaucugauugcuagugauugauacucuuuguccauucacuuuagcaaaaccucucuuguaaauuaauucccuaacagauuucaaauugggguaaccccauguaauguaagguucacauauucuaagcauguuaaugguagcuuuguugaguuuuacaaaaacuccauuguugaucugaaguagacggaaaaguugaagaacuuuacguacuuuuggugcuacuuuauugauacccuuaauacggauaacgaaagc

SEQ ID NO: 1437 - RNA, 351 nt, artificial sequence
  synthetic construct
guauuugaaccuggauccaacagugaacaguucaugaaucaaaucuucaauacagauaaugccagauuuuccuaaucugucuucaaugaucugauugcuagugauugauacucuuuguccauucacuuuagcaaaaccucucuuguaaauuaauucccuaacagauuucaaauugggguaaccccauguaauguaagguucacauauucuaagcauguuaaugguagcuuuguugaguuuuacaaaaacuccauuguugaucugaaguagacggaaaaguugaagaacuuuacguacuuuuggugcuacuuuauugauacccuuaauacggauaacgaaagccaauuuagc

SEQ ID NO: 1438 - RNA, 351 nt, artificial sequence
  synthetic construct
gaguagacggaaaaguugaagaacuuuacguacuuuuggugcuacuuuauugauacccuuaauacggauaacgaaagccaauuuagccucuccagguacauagaaauuacccuuauuuuuagcuugacgaauuaaccuuauuucaucucguucuuuuaaucuguauuccuuaacauacuguucugcucuuuugaaaauaucuuuucucuuuuugauuuguucagacuucuucuuuacaauggauugaagccuuuuagcccuagaggcuucacgucuuuugcgguguuuuaagaccgauucaggaacugcaggcagucccuuuacggucuuaguuuuuuugucaguuuuagc

SEQ ID NO: 1439 - RNA, 351 nt, artificial sequence
  synthetic construct
gaucugauugcuagugauugauacucuuuguccauucacuuuagcaaaaccucucuuguaaauuaauucccuaacagauuucaaauugggguaaccccauguaauguaagguucacauauucuaagcauguuaaugguagcuuuguugaguuuuacaaaaacuccauuguugaucugaaguagacggaaaaguugaagaacuuuacguacuuuuggugcuacuuuauugauacccuuaauacggauaacgaaagccaauuuagccucuccagguacauagaaauuacccuuauuuuuagcuugacgaauuaaccuuauuucaucucguucuuuuaaucuguauuccuuaac

SEQ ID NO: 1440 - RNA, 351 nt, artificial sequence
  synthetic construct
guuuucauacucuguauugcauucuucucuucccgaagguguaaaauucgaauauuccggaaaguauuucucuauuuuucuuccuuguucgaucuuccuuugaaguaugucuugcuuauucagaaaaacaaucauugcggcaucuuuaacauacacauuugaauagauaucuugaaacagauuaaaagacuccugaagucuauuaacgcuuucgucuucucuuaauuucaaaucaaaaucgcuggacgcuauuaaaaauagaauagccugaaugccggcgaacacuuuuauccauuuuuuucuuucgccacguugcccgccuacaucgaacauccagaauucagccaugcc

SEQ ID NO: 1441 - RNA, 352 nt, artificial sequence
  synthetic construct
guuaaaguauuccggaguaaauucauuugguccuucuuggccuauuuucacgaugaaaucgaucgaauuuauaguuuccucguuuuugacuuugacaggaggauuaauuuuauucauauuagugaugaugucauagauagauucaugaauauuuuguuugauguaugggauuuuuucuuuucuuucauuaucugaguaaccauuaauauguaaaauuuucaucuguuugaugaucguaguuuuuccagacucgccaguucccaaaaguaaaaguuuuuucacuucuaaaaacuuuuucguauagagaagauggucuuugucuucuuuaccaucuuuaccacauaccaucuuc

SEQ ID NO: 1442 - RNA, 351 nt, artificial sequence
  synthetic construct
guuuucauaaacaaucuaacuuuuucauacucuguauugcauucuucucuucccgaagguguaaaauucgaauauuccggaaaguauuucucuauuuuucuuccuuguucgaucuuccuuugaaguaugucuugcuuauucagaaaaacaaucauugcggcaucuuuaacauacacauuugaauagauaucuugaaacagauuaaaagacuccugaagucuauuaacgcuuucgucuucucuuaauuucaaaucaaaaucgcuggacgcuauuaaaaauagaauagccugaaugccggcgaacacuuuuauccauuuuuuucuuucgccacguugcccgccuacaucgaac

SEQ ID NO: 1443 - RNA, 352 nt, artificial sequence
  synthetic construct
guuucauaaacaaucuaacuuuuucauacucuguauugcauucuucucuucccgaagguguaaaauucgaauauuccggaaaguauuucucuauuuuucuuccuuguucgaucuuccuuugaaguaugucuugcuuauucagaaaaacaaucauugcggcaucuuuaacauacacauuugaauagauaucuugaaacagauuaaaagacuccugaagucuauuaacgcuuucgucuucucuuaauuucaaaucaaaaucgcuggacgcuauuaaaaauagaauagccugaaugccggcgaacacuuuuauccauuuuuuucuuucgccacguugcccgccuacaucgaacac

SEQ ID NO: 1444 - RNA, 351 nt, artificial sequence
  synthetic construct
guaccuggucucauucccauauuuucuacgaauacaggcauucuugcaauuccuaaaaucuuguuuuucauaaacaaucuaacuuuuucauacucuguauugcauucuucucuucccgaagguguaaaauucgaauauuccggaaaguauuucucuauuuuucuuccuuguucgaucuuccuuugaaguaugucuugcuuauucagaaaaacaaucauugcggcaucuuuaacauacacauuugaauagauaucuugaaacagauuaaaagacuccugaagucuauuaacgcuuucgucuucucuuaauuucaaaucaaaaucgcuggacgcuauuaaaaauagaauagcc

SEQ ID NO: 1445 - RNA, 351 nt, artificial sequence
  synthetic construct
gcucgguuuuagcuguucggugauauuuuuaccuggucucauucccauauuuucuacgaauacaggcauucuugcaauuccuaaaaucuuguuuuucauaaacaaucuaacuuuuucauacucuguauugcauucuucucuucccgaagguguaaaauucgaauauuccggaaaguauuucucuauuuuucuuccuuguucgaucuuccuuugaaguaugucuugcuuauucagaaaaacaaucauugcggcaucuuuaacauacacauuugaauagauaucuugaaacagauuaaaagacuccugaagucuauuaacgcuuucgucuucucuuaauuucaaaucaaaauc

SEQ ID NO: 1446 - RNA, 351 nt, artificial sequence
  synthetic construct
gauuguggauauauacaucccucgguuuuagcuguucggugauauuuuuaccuggucucauucccauauuuucuacgaauacaggcauucuugcaauuccuaaaaucuuguuuuucauaaacaaucuaacuuuuucauacucuguauugcauucuucucuucccgaagguguaaaauucgaauauuccggaaaguauuucucuauuuuucuuccuuguucgaucuuccuuugaaguaugucuugcuuauucagaaaaacaaucauugcggcaucuuuaacauacacauuugaauagauaucuugaaacagauuaaaagacuccugaagucuauuaacgcuuucgucuucuc

SEQ ID NO: 1447 - RNA, 352 nt, artificial sequence
  synthetic construct
guuuuagcuguucggugauauuuuuaccuggucucauucccauauuuucuacgaauacaggcauucuugcaauuccuaaaaucuuguuuuucauaaacaaucuaacuuuuucauacucuguauugcauucuucucuucccgaagguguaaaauucgaauauuccggaaaguauuucucuauuuuucuuccuuguucgaucuuccuuugaaguaugucuugcuuauucagaaaaacaaucauugcggcaucuuuaacauacacauuugaauagauaucuugaaacagauuaaaagacuccugaagucuauuaacgcuuucgucuucucuuaauuucaaaucaaaaucgcuggc

SEQ ID NO: 1448 - RNA, 351 nt, artificial sequence
  synthetic construct
guauauacaucccucgguuuuagcuguucggugauauuuuuaccuggucucauucccauauuuucuacgaauacaggcauucuugcaauuccuaaaaucuuguuuuucauaaacaaucuaacuuuuucauacucuguauugcauucuucucuucccgaagguguaaaauucgaauauuccggaaaguauuucucuauuuuucuuccuuguucgaucuuccuuugaaguaugucuugcuuauucagaaaaacaaucauugcggcaucuuuaacauacacauuugaauagauaucuugaaacagauuaaaagacuccugaagucuauuaacgcuuucgucuucucuuaauuuc

SEQ ID NO: 1449 - RNA, 352 nt, artificial sequence
  synthetic construct
guauugcauucuucucuucccgaagguguaaaauucgaauauuccggaaaguauuucucuauuuuucuuccuuguucgaucuuccuuugaaguaugucuugcuuauucagaaaaacaaucauugcggcaucuuuaacauacacauuugaauagauaucuugaaacagauuaaaagacuccugaagucuauuaacgcuuucgucuucucuuaauuucaaaucaaaaucgcuggacgcuauuaaaaauagaauagccugaaugccggcgaacacuuuuauccauuuuuuucuuucgccacguugcccgccuacaucgaacauccagaauucagccaugccgccuccguauuuuc

SEQ ID NO: 1450 - RNA, 352 nt, artificial sequence
  synthetic construct
gucuguucgggcguuuacaucaaaaagaucgccagcacccaaagcguauguuaaggaaucuucaaaugcucccaaaugguaguaaacuuuacuugcuaccaaugcagccaguuggugcuguugaaauacuuugucuucaugaagaauuucaauuuucucgauagcuucugaaaucucuggccaaaauucaucaacaauggaaucuaauuuuuuuagagcaaauacuuucaauucuggucuugguucuucuaguagggauauuauccccgcagcugaaguaauauucauuuuaaaagcacuugaaaaucuuaauaaguuuucguugcaagcacaauuaaaauuuucggaaauc

SEQ ID NO: 1451 - RNA, 351 nt, artificial sequence
  synthetic construct
gccgcuacguguaguaauuuccugauggcuugauuguguccaguaccgcaguaagccauggcuaagguauacauuccggaccgucuuaaaauuggauccuuaucugaagucagcugauggauuagugaaucggccucuucuagacgaccguacaucgugaaacuuauacccacugcuaauccacgcaggauuuuuucauguugacuuucuugugcguacgccaccauauccauuauaguugccgaauuauuggagcccaacaugaccauacccauggcuauaccagcggcuucuccgguauucgcgucgucuugauagagauugaauuugaguuguucauaaacgucgugc

SEQ ID NO: 1452 - RNA, 352 nt, artificial sequence
  synthetic construct
guaccaauaaugucaucagcuuguguaauggacaauucaaaaauguccauucuucuaguuuccaaagcgagucccauggccugucgguuuuguccgucaucuaaacaacguugaaacauacgauucacaauggccucaagucuggcaucaaugggcuuugcaucucguacgccuucagccaaagcaaugcgauguuguguguaauaaucaauacauuuggcaagugucguuuccacauacucuguucgggcguuuacaucaaaaagaucgccagcacccaaagcguauguuaaggaaucuucaaaugcucccaaaugguaguaaacuuuacuugcuaccaaugcagccaguc

SEQ ID NO: 1453 - RNA, 352 nt, artificial sequence
  synthetic construct
guuuggaucaaacucauagcgaccugaaaagcauaggucagcauaccaauaaugucaucagcuuguguaauggacaauucaaaaauguccauucuucuaguuuccaaagcgagucccauggccugucgguuuuguccgucaucuaaacaacguugaaacauacgauucacaauggccucaagucuggcaucaaugggcuuugcaucucguacgccuucagccaaagcaaugcgauguuguguguaauaaucaauacauuuggcaagugucguuuccacauacucuguucgggcguuuacaucaaaaagaucgccagcacccaaagcguauguuaaggaaucuucaaaugcuc

SEQ ID NO: 1454 - RNA, 352 nt, artificial sequence
  synthetic construct
guucugaauaacaagaaaccaagagcuguaacugcagcucuucggacaucaucguugacaucugacaccgcuacguguaguaauuuccugauggcuugauuguguccaguaccgcaguaagccauggcuaagguauacauuccggaccgucuuaaaauuggauccuuaucugaagucagcugauggauuagugaaucggccucuucuagacgaccguacaucgugaaacuuauacccacugcuaauccacgcaggauuuuuucauguugacuuucuugugcguacgccaccauauccauuauaguugccgaauuauuggagcccaacaugaccauacccauggcuauaccac

SEQ ID NO: 1455 - RNA, 351 nt, artificial sequence
  synthetic construct
gauuucgcaccaugaugaugccgccuaucgaaacaucuuucaucgccguguacugcgugcuaucguugauugugaucaccuucaauugcugccucaugguccuggcaggauuuugcaagauuucgaaauucgguucggguuccuucuucuucuccuccuuuucgucuuucuuuuccuuuuuaucaucggccgucgaaguugaagguuucuugucguccgcuuucuucucuucgggcuucuugucuuccuuuuuuucuuccgguuucuuuucuuccuuuucgguuuuuuugucguccuuuucuucguccacguccauuuuuucgucgcgaugcuuucuuucguggucucucc

SEQ ID NO: 1456 - RNA, 351 nt, artificial sequence
  synthetic construct
guuuaucuaagauuucagccacugggagagggucgucuaagaaaauuagacacuggcacauauugacguaaucgggaguaguuagaccccgauacagaccaacuagagaccucaggacgguguuucggaaugcgcgguuuuggaucaaacucauagcgaccugaaaagcauaggucagcauaccaauaaugucaucagcuuguguaauggacaauucaaaaauguccauucuucuaguuuccaaagcgagucccauggccugucgguuuuguccgucaucuaaacaacguugaaacauacgauucacaauggccucaagucuggcaucaaugggcuuugcaucucguacgc

SEQ ID NO: 1457 - RNA, 352 nt, artificial sequence
  synthetic construct
guaucgaaacaucuuucaucgccguguacugcgugcuaucguugauugugaucaccuucaauugcugccucaugguccuggcaggauuuugcaagauuucgaaauucgguucggguuccuucuucuucuccuccuuuucgucuuucuuuuccuuuuuaucaucggccgucgaaguugaagguuucuugucguccgcuuucuucucuucgggcuucuugucuuccuuuuuuucuuccgguuucuuuucuuccuuuucgguuuuuuugucguccuuuucuucguccacguccauuuuuucgucgcgaugcuuucuuucguggucucuccugcgcugccuagcggcuauacucac

SEQ ID NO: 1458 - RNA, 351 nt, artificial sequence
  synthetic construct
gucuaccaauucuucuucgccaggcuucaaauuucgcaccaugaugaugccgccuaucgaaacaucuuucaucgccguguacugcgugcuaucguugauugugaucaccuucaauugcugccucaugguccuggcaggauuuugcaagauuucgaaauucgguucggguuccuucuucuucuccuccuuuucgucuuucuuuuccuuuuuaucaucggccgucgaaguugaagguuucuugucguccgcuuucuucucuucgggcuucuugucuuccuuuuuuucuuccgguuucuuuucuuccuuuucgguuuuuuugucguccuuuucuucguccacguccauuuuuuc

SEQ ID NO: 1459 - RNA, 352 nt, artificial sequence
  synthetic construct
guucuaauucaucuucauccauaucaucugagaaaccaacuggauuacuaauagcguuugugaucucauuggcaaugucguguuguuccgcuauaucauccauuauaucaugaacauuaucaacauccagguucuugugugcuuuuuuaagggcaucagcagcauuuuucauagaaucuaaaaccgcuguguuaguacuagcuccuucgagggcuucccuuugcauuucaauaguuguaaguguuccaucgauuugcaguugagucuuuuccaaucuuuucuucuucuuaagagcuugaagggccacucguuuauucuuagaggcauuuuucuuagcuaauaauguguauuc

SEQ ID NO: 1460 - RNA, 352 nt, artificial sequence
  synthetic construct
guuucuaauucaucuucauccauaucaucugagaaaccaacuggauuacuaauagcguuugugaucucauuggcaaugucguguuguuccgcuauaucauccauuauaucaugaacauuaucaacauccagguucuugugugcuuuuuuaagggcaucagcagcauuuuucauagaaucuaaaaccgcuguguuaguacuagcuccuucgagggcuucccuuugcauuucaauaguuguaaguguuccaucgauuugcaguugagucuuuuccaaucuuuucuucuucuuaagagcuugaagggccacucguuuauucuuagaggcauuuuucuuagcuaauaauguguauc

SEQ ID NO: 1461 - RNA, 352 nt, artificial sequence
  synthetic construct
guuuuuaagggcaucagcagcauuuuucauagaaucuaaaaccgcuguguuaguacuagcuccuucgagggcuucccuuugcauuucaauaguuguaaguguuccaucgauuugcaguugagucuuuuccaaucuuuucuucuucuuaagagcuugaagggccacucguuuauucuuagaggcauuuuucuuagcuaauaauguguauucuucuauuuucuuuucuaaaaauuccuguuuuuuguauaacauuucuucaguuucucuaagcuucuggauagcuucgccugggguaggaccuucaucuuuuucuuucccuccgaauauuuuauugaaaaagcucauuuuaaac

SEQ ID NO: 1462 - RNA, 350 nt, artificial sequence
  synthetic construct
ggaaccuugaguaaaucuucuucuaaaccuucuuguucgagcuccuccaguuccuuuucuaauucaucuucauccauaucaucugagaaaccaacuggauuacuaauagcguuugugaucucauuggcaaugucguguuguuccgcuauaucauccauuauaucaugaacauuaucaacauccagguucuugugugcuuuuuuaagggcaucagcagcauuuuucauagaaucuaaaaccgcuguguuaguacuagcuccuucgagggcuucccuuugcauuucaauaguuguaaguguuccaucgauuugcaguugagucuuuuccaaucuuuucuucuucuuaagagc

SEQ ID NO: 1463 - RNA, 351 nt, artificial sequence
  synthetic construct
gucucauuggcaaugucguguuguuccgcuauaucauccauuauaucaugaacauuaucaacauccagguucuugugugcuuuuuuaagggcaucagcagcauuuuucauagaaucuaaaaccgcuguguuaguacuagcuccuucgagggcuucccuuugcauuucaauaguuguaaguguuccaucgauuugcaguugagucuuuuccaaucuuuucuucuucuuaagagcuugaagggccacucguuuauucuuagaggcauuuuucuuagcuaauaauguguauucuucuauuuucuuuucuaaaaauuccuguuuuuuguauaacauuucuucaguuucucuaagc

SEQ ID NO: 1464 - RNA, 352 nt, artificial sequence
  synthetic construct
guaaaccuucuuguucgagcuccuccaguuccuuuucuaauucaucuucauccauaucaucugagaaaccaacuggauuacuaauagcguuugugaucucauuggcaaugucguguuguuccgcuauaucauccauuauaucaugaacauuaucaacauccagguucuugugugcuuuuuuaagggcaucagcagcauuuuucauagaaucuaaaaccgcuguguuaguacuagcuccuucgagggcuucccuuugcauuucaauaguuguaaguguuccaucgauuugcaguugagucuuuuccaaucuuuucuucuucuuaagagcuugaagggccacucguuuauucuc

SEQ ID NO: 1465 - RNA, 351 nt, artificial sequence
  synthetic construct
gcugagaaaccaacuggauuacuaauagcguuugugaucucauuggcaaugucguguuguuccgcuauaucauccauuauaucaugaacauuaucaacauccagguucuugugugcuuuuuuaagggcaucagcagcauuuuucauagaaucuaaaaccgcuguguuaguacuagcuccuucgagggcuucccuuugcauuucaauaguuguaaguguuccaucgauuugcaguugagucuuuuccaaucuuuucuucuucuuaagagcuugaagggccacucguuuauucuuagaggcauuuuucuuagcuaauaauguguauucuucuauuuucuuuucuaaaaauucc

SEQ ID NO: 1466 - RNA, 352 nt, artificial sequence
  synthetic construct
guaucaucgucauccucgacuuuucuagcugcagguuuaacaacugccggcuuagcaauagcuccagcgggcacggcuggaaguucuguagguccgggaaccuugaguaaaucuucuucuaaaccuucuuguucgagcuccuccaguuccuuuucuaauucaucuucauccauaucaucugagaaaccaacuggauuacuaauagcguuugugaucucauuggcaaugucguguuguuccgcuauaucauccauuauaucaugaacauuaucaacauccagguucuugugugcuuuuuuaagggcaucagcagcauuuuucauagaaucuaaaaccgcuguguuaguacuac

SEQ ID NO: 1467 - RNA, 352 nt, artificial sequence
  synthetic construct
gucauaucaucgucauccucgacuuuucuagcugcagguuuaacaacugccggcuuagcaauagcuccagcgggcacggcuggaaguucuguagguccgggaaccuugaguaaaucuucuucuaaaccuucuuguucgagcuccuccaguuccuuuucuaauucaucuucauccauaucaucugagaaaccaacuggauuacuaauagcguuugugaucucauuggcaaugucguguuguuccgcuauaucauccauuauaucaugaacauuaucaacauccagguucuugugugcuuuuuuaagggcaucagcagcauuuuucauagaaucuaaaaccgcuguguuaguac

SEQ ID NO: 1468 - RNA, 352 nt, artificial sequence
  synthetic construct
guucuucuaaaccuucuuguucgagcuccuccaguuccuuuucuaauucaucuucauccauaucaucugagaaaccaacuggauuacuaauagcguuugugaucucauuggcaaugucguguuguuccgcuauaucauccauuauaucaugaacauuaucaacauccagguucuugugugcuuuuuuaagggcaucagcagcauuuuucauagaaucuaaaaccgcuguguuaguacuagcuccuucgagggcuucccuuugcauuucaauaguuguaaguguuccaucgauuugcaguugagucuuuuccaaucuuuucuucuucuuaagagcuugaagggccacucguuc

SEQ ID NO: 1469 - RNA, 352 nt, artificial sequence
  synthetic construct
guaauuccuucauaucaucgucauccucgacuuuucuagcugcagguuuaacaacugccggcuuagcaauagcuccagcgggcacggcuggaaguucuguagguccgggaaccuugaguaaaucuucuucuaaaccuucuuguucgagcuccuccaguuccuuuucuaauucaucuucauccauaucaucugagaaaccaacuggauuacuaauagcguuugugaucucauuggcaaugucguguuguuccgcuauaucauccauuauaucaugaacauuaucaacauccagguucuugugugcuuuuuuaagggcaucagcagcauuuuucauagaaucuaaaaccgcugc

SEQ ID NO: 1470 - RNA, 350 nt, artificial sequence
  synthetic construct
guuuuaagcgauucccaauaggaacgauucaaauaucuagccaauucuggaucuucuugaggcugaggaggaguuuguggucuuucgacugguguugguucuuucacauuauacaaagcacuuguugcccuuauuuuuucuuuuucuuuggcuucagcuucugauugacucaaagcuaaagcuaauugcaguuccuccucuucucucaauucaucuucacuuuucuuaggaggauccuguuucuguugugccaaugaacuuuuuaaauauuccucaggcaaaucuguuucacuggaagaaauagaagauuuugaugcaguggcugguuuaguaacuucaucauaacaagc

SEQ ID NO: 1471 - RNA, 351 nt, artificial sequence
  synthetic construct
guucccaauaggaacgauucaaauaucuagccaauucuggaucuucuugaggcugaggaggaguuuguggucuuucgacugguguugguucuuucacauuauacaaagcacuuguugcccuuauuuuuucuuuuucuuuggcuucagcuucugauugacucaaagcuaaagcuaauugcaguuccuccucuucucucaauucaucuucacuuuucuuaggaggauccuguuucuguugugccaaugaacuuuuuaaauauuccucaggcaaaucuguuucacuggaagaaauagaagauuuugaugcaguggcugguuuaguaacuucaucauaacaagcaucacauacuc

SEQ ID NO: 1472 - RNA, 351 nt, artificial sequence
  synthetic construct
gagacgauacgccguguccuacaaacugcggggcgccauuaggcagugaagaauucgaaguuacuccuugaggaaagccgggcggagggccuaaagcaguauuaugagcugguugcugcccuagaggaccauguggugguccuccagguaaaccgacuugacucggaacgcuuugcggaggcaucaugugcugaggaaaugaauaaguguuguaauuacccauggacugguucggguuggaaggaaacuguuguccaugauguggagaauucauauauccauauugagguaacauauauugcuguuuuugcuguuccugucucauuugcauuucucucucuuguucuuggc

SEQ ID NO: 1473 - RNA, 352 nt, artificial sequence
  synthetic construct
guauacaaagcacuuguugcccuuauuuuuucuuuuucuuuggcuucagcuucugauugacucaaagcuaaagcuaauugcaguuccuccucuucucucaauucaucuucacuuuucuuaggaggauccuguuucuguugugccaaugaacuuuuuaaauauuccucaggcaaaucuguuucacuggaagaaauagaagauuuugaugcaguggcugguuuaguaacuucaucauaacaagcaucacauacucucaccuccuuuucaauuccauauuugggcaaaguagaagucuuugaagugcacuggccacaaaacacuugaccacaggcucugcaaugaugcuuucuuc

SEQ ID NO: 1474 - RNA, 350 nt, artificial sequence
  synthetic construct
guugguuuuaagcgauucccaauaggaacgauucaaauaucuagccaauucuggaucuucuugaggcugaggaggaguuuguggucuuucgacugguguugguucuuucacauuauacaaagcacuuguugcccuuauuuuuucuuuuucuuuggcuucagcuucugauugacucaaagcuaaagcuaauugcaguuccuccucuucucucaauucaucuucacuuuucuuaggaggauccuguuucuguugugccaaugaacuuuuuaaauauuccucaggcaaaucuguuucacuggaagaaauagaagauuuugaugcaguggcugguuuaguaacuucaucauaac

SEQ ID NO: 1475 - RNA, 352 nt, artificial sequence
  synthetic construct
guuaacucugcaguuugugccucuccauuuguuuugacuuguggacuagccgguggagcuccaggcugcugaaauuggggcgacaucuguccuugaugcggaaaauuuugauucugagaaauuccuccuugcaugggaaucccacccugcugcggcggcaguccaccuugagggggcaucauuccacccugauuauggggaaucccgcccugauguugagguauucccuguuggguauucggagaauugggaggcaagccagguuguccgccgcccaucauauguugagacgauacgccguguccuacaaacugcggggcgccauuaggcagugaagaauucgaaguuacuc

SEQ ID NO: 1476 - RNA, 351 nt, artificial sequence
  synthetic construct
gaggaacgauucaaauaucuagccaauucuggaucuucuugaggcugaggaggaguuuguggucuuucgacugguguugguucuuucacauuauacaaagcacuuguugcccuuauuuuuucuuuuucuuuggcuucagcuucugauugacucaaagcuaaagcuaauugcaguuccuccucuucucucaauucaucuucacuuuucuuaggaggauccuguuucuguugugccaaugaacuuuuuaaauauuccucaggcaaaucuguuucacuggaagaaauagaagauuuugaugcaguggcugguuuaguaacuucaucauaacaagcaucacauacucucaccucc

SEQ ID NO: 1477 - RNA, 351 nt, artificial sequence
  synthetic construct
guugcaucugauucucuggguguuggaaauuugugaccuuccauuuucauuguauucacaagguccuuaagcgcuccauguuuaggauucuuccuaaagacaaaauuccagguuugaauaaguucuaacaguuuacuucgaacauuuucaugaggugugguuuuugauaauucaugaaggaaaucacagaaugauuuagugguuaauucuucaugaacuauuaugccacaauuuuuuaccauacuuuccaaaacuaacaaagcauacaaugcagaaugaggauuuugugaguauaguuucuuucuuaaugcaguuaaggcauaucuugguuguacaucauucugucuaauc

SEQ ID NO: 1478 - RNA, 351 nt, artificial sequence
  synthetic construct
gcuuuggcuucagcuucugauugacucaaagcuaaagcuaauugcaguuccuccucuucucucaauucaucuucacuuuucuuaggaggauccuguuucuguugugccaaugaacuuuuuaaauauuccucaggcaaaucuguuucacuggaagaaauagaagauuuugaugcaguggcugguuuaguaacuucaucauaacaagcaucacauacucucaccuccuuuucaauuccauauuugggcaaaguagaagucuuugaagugcacuggccacaaaacacuugaccacaggcucugcaaugaugcuuucuuuggaguacacugaauuguacacgacaucuaugacac

SEQ ID NO: 1479 - RNA, 352 nt, artificial sequence
  synthetic construct
guucacauuauacaaagcacuuguugcccuuauuuuuucuuuuucuuuggcuucagcuucugauugacucaaagcuaaagcuaauugcaguuccuccucuucucucaauucaucuucacuuuucuuaggaggauccuguuucuguugugccaaugaacuuuuuaaauauuccucaggcaaaucuguuucacuggaagaaauagaagauuuugaugcaguggcugguuuaguaacuucaucauaacaagcaucacauacucucaccuccuuuucaauuccauauuugggcaaaguagaagucuuugaagugcacuggccacaaaacacuugaccacaggcucugcaaugaugc

SEQ ID NO: 1480 - RNA, 350 nt, artificial sequence
  synthetic construct
guaaaccgacuugacucggaacgcuuugcggaggcaucaugugcugaggaaaugaauaaguguuguaauuacccauggacugguucggguuggaaggaaacuguuguccaugauguggagaauucauauauccauauugagguaacauauauugcuguuuuugcuguuccugucucauuugcauuucucucucuuguucuuggauccuuuguagcgccaauugucucugguacugaagauauuccuguuuuuucuuccucaugacuuccaauuuaugcgccauuugcauuugacgcauucuuucuugcuccucagccucucuucucaucuuuucauuguguucuucgcgc

SEQ ID NO: 1481 - RNA, 351 nt, artificial sequence
  synthetic construct
gaacauugcuggaguaaauccaggguuauuuuguuccaaaaauuucugugcuacuauugcuucuugaagaccaggaaacagauuuucauaaucuuuaggaucugccaagcuuuguccugcuuucugauugauaguagacaacuguguucuccagagaucuaccacuucugagauuuuaucagguaaguaagaccucgcaaagaaagcugcuucuggaagucuuccaguuguuaucaauauauucagacauuuauuuaaaucgccaacuaagaaaugagacaagaaagauagauuauguuugccuucuguuugaguggcauccccuagcgcccuuacuacuuuuucaucucc

SEQ ID NO: 1482 - RNA, 352 nt, artificial sequence
  synthetic construct
guuugucuacuaaauaaagccugucaucuuuagggacauaaccaagaacauaaagugguccaucuagaugggcuauuguuacaaguucaccuccaacaaaguaauuuauacgguuuacagaauuuguguaaaugaaacaaucuccuacccauagaccaguacguacagacucauuaauuucacccaagagauuaaaagccgauucaacuccaucaucagcaaccugauuauugucuuuggcccuuuguacuucaucagaaucauaugagaguauaaaauaacuaucuucaguggccaagcaaacuaauuugccacugucagaccaauauauugcccgugguuguauuucaac

SEQ ID NO: 1483 - RNA, 351 nt, artificial sequence
  synthetic construct
guuucaucuauauucacaccauccaggucuaaaucuaugucgucgucaucaucaucuugaucaauugagaguuucuucaauugcucaauaggugccuucacagaauauugagaagaacucccaguuacuccacuauucuucgacugggcuuccaccucagcuauaacguuucuuucaugauuuggggugauacugguugcuaacauugcuggaguaaauccaggguuauuuuguuccaaaaauuucugugcuacuauugcuucuugaagaccaggaaacagauuuucauaaucuuuaggaucugccaagcuuuguccugcuuucugauugauaguagacaacuguguucuc

SEQ ID NO: 1484 - RNA, 351 nt, artificial sequence
  synthetic construct
gucugaaugucuagcccaaauaauuuuuccaccacuugcauccauacuaacagcugguuccucucuaccaacuuucaccaaaaugcuacccucaucauaaccuaaagcaacauuauuggaacccuucaagcagaaaauaguccauacucuuucaaagccauaguucaaacugcuuucuaaucugugaguauuugcaugccaaacucugauaguaccaucuucacuuccaguaagagcuauugggaguucaggauggaaacaaacagcaguaacguuuuguccauguccuucuaaaguuuggacacaaguuuuauucugguaaucccaaauuuugacuaaucuaucaucugc

SEQ ID NO: 1485 - RNA, 351 nt, artificial sequence
  synthetic construct
gaauucugaaugucuagcccaaauaauuuuuccaccacuugcauccauacuaacagcugguuccucucuaccaacuuucaccaaaaugcuacccucaucauaaccuaaagcaacauuauuggaacccuucaagcagaaaauaguccauacucuuucaaagccauaguucaaacugcuuucuaaucugugaguauuugcaugccaaacucugauaguaccaucuucacuuccaguaagagcuauugggaguucaggauggaaacaaacagcaguaacguuuuguccauguccuucuaaaguuuggacacaaguuuuauucugguaaucccaaauuuugacuaaucuaucauc

SEQ ID NO: 1486 - RNA, 352 nt, artificial sequence
  synthetic construct
guugcauccauacuaacagcugguuccucucuaccaacuuucaccaaaaugcuacccucaucauaaccuaaagcaacauuauuggaacccuucaagcagaaaauaguccauacucuuucaaagccauaguucaaacugcuuucuaaucugugaguauuugcaugccaaacucugauaguaccaucuucacuuccaguaagagcuauugggaguucaggauggaaacaaacagcaguaacguuuuguccauguccuucuaaaguuuggacacaaguuuuauucugguaaucccaaauuuugacuaaucuaucaucugcaccagauauuagguaugguuuaucaccuccauggc

SEQ ID NO: 1487 - RNA, 352 nt, artificial sequence
  synthetic construct
gauucugaaugucuagcccaaauaauuuuuccaccacuugcauccauacuaacagcugguuccucucuaccaacuuucaccaaaaugcuacccucaucauaaccuaaagcaacauuauuggaacccuucaagcagaaaauaguccauacucuuucaaagccauaguucaaacugcuuucuaaucugugaguauuugcaugccaaacucugauaguaccaucuucacuuccaguaagagcuauugggaguucaggauggaaacaaacagcaguaacguuuuguccauguccuucuaaaguuuggacacaaguuuuauucugguaaucccaaauuuugacuaaucuaucaucuc

SEQ ID NO: 1488 - RNA, 352 nt, artificial sequence
  synthetic construct
gaccaaauccaaaguuucccaaucauagaaagucaauccagaaacagauuuuacacccagaagguagccuccaaauauaccuucagcaccaaaaucagauuugaaauucuucuuuucuuugaaauuuuuaaauauucuaauuguagauccagauucccugauagcauauucacuugaaucuugagcccacacaaacucuugggcacuuccaaaagcuuuguuccuuaaugccauagcuguguaaaugauguauucuccaucuccacaaacuaccacgaaacgaccauuuggauugugcuggauaguuuguggguagaugucacaugcacccauaucuuucacagaaacuggc

SEQ ID NO: 1489 - RNA, 352 nt, artificial sequence
  synthetic construct
guauuucaauucuucuaaccaaauccaaaguuucccaaucauagaaagucaauccagaaacagauuuuacacccagaagguagccuccaaauauaccuucagcaccaaaaucagauuugaaauucuucuuuucuuugaaauuuuuaaauauucuaauuguagauccagauucccugauagcauauucacuugaaucuugagcccacacaaacucuugggcacuuccaaaagcuuuguuccuuaaugccauagcuguguaaaugauguauucuccaucuccacaaacuaccacgaaacgaccauuuggauugugcuggauaguuuguggguagaugucacaugcacccauauc

SEQ ID NO: 1490 - RNA, 351 nt, artificial sequence
  synthetic construct
gcuuacuacuuuuucaucuccugagcuaguagcuaaaaguagcaacccuccguaaucuugagccuucugcauacauucuuuggcuaauucuagauuguucguagaagcugcaaguucggcaaguuggcuccauuucugaggguuauuagcuuccugagcuaaggcucuggcuguguuuagaucuucuagugcaacugcuaguucaaaucuauguucaggaucugaacuaacugccaaagcuuguugcuuaaaaccuugcuuuucuaagaaaugugccacucugguucuaugcucuuuuggaauagaaggcaagacucuaucagcaguugaaaaaucucuccucaucacagc

SEQ ID NO: 1491 - RNA, 351 nt, artificial sequence
  synthetic construct
guuccucucuaccaacuuucaccaaaaugcuacccucaucauaaccuaaagcaacauuauuggaacccuucaagcagaaaauaguccauacucuuucaaagccauaguucaaacugcuuucuaaucugugaguauuugcaugccaaacucugauaguaccaucuucacuuccaguaagagcuauugggaguucaggauggaaacaaacagcaguaacguuuuguccauguccuucuaaaguuuggacacaaguuuuauucugguaaucccaaauuuugacuaaucuaucaucugcaccagauauuagguaugguuuaucaccuccaugguaauaaucaacacaguuuacuc

SEQ ID NO: 1492 - RNA, 352 nt, artificial sequence
  synthetic construct
guuacggauaucaacgucacacuucaugauggaguuguagacgguuucguggauaccgcaagauuccauacccaagaaggaagguuggaagagggcuucuggacaacggaaucucucguuaccgauggugaugaccuguccaucgggaaguucguagcucuuuuccaaagagguugaagcggcagcgguggccauuuccuguucgaagucgagggcgacauagcaaaguuucuccuugaugucacggacgauuucucuuucagcugugguggugaaugaguaaccucuuucggucaagauuuucaugagguagucggucaaaucacgaccagccaaguccaaacggaggauc

SEQ ID NO: 1493 - RNA, 352 nt, artificial sequence
  synthetic construct
guugggguugaguggagcuucugucaggaggacgggguguucuucuggggcgacacggaguucguuguagaaggugugaugccagaucuuuuccauaucaucccaguuggugaugauaccguguucaaugggguauuucaaugugaggauaccucuuuugcuuugggcuucaucuccuacguaagagucuuuuugucccauuccuaccauuacacccugaugucuugggcguccgacgauggaugggaauacggcacggggcgcgucauccccggcgaaaccggccuugcacauaccggauccauugucuacaacuaaagcggcaacuucuucuucacacauuuugauaggc

SEQ ID NO: 1494 - RNA, 352 nt, artificial sequence
  synthetic construct
gugauuugggucaucuuuucucuguuugccuugggguugaguggagcuucugucaggaggacgggguguucuucuggggcgacacggaguucguuguagaaggugugaugccagaucuuuuccauaucaucccaguuggugaugauaccguguucaaugggguauuucaaugugaggauaccucuuuugcuuugggcuucaucuccuacguaagagucuuuuugucccauuccuaccauuacacccugaugucuugggcguccgacgauggaugggaauacggcacggggcgcgucauccccggcgaaaccggccuugcacauaccggauccauugucuacaacuaaagcgc

SEQ ID NO: 1495 - RNA, 352 nt, artificial sequence
  synthetic construct
guuugggucaucuuuucucuguuugccuugggguugaguggagcuucugucaggaggacgggguguucuucuggggcgacacggaguucguuguagaaggugugaugccagaucuuuuccauaucaucccaguuggugaugauaccguguucaaugggguauuucaaugugaggauaccucuuuugcuuugggcuucaucuccuacguaagagucuuuuugucccauuccuaccauuacacccugaugucuugggcguccgacgauggaugggaauacggcacggggcgcgucauccccggcgaaaccggccuugcacauaccggauccauugucuacaacuaaagcggcac

SEQ ID NO: 1496 - RNA, 350 nt, artificial sequence
  synthetic construct
gaagccaagauggauccaccgauccauacggaguauuuccuuucugggggugcgaugaucuugaucuugauggugcuuggagccaaggcggugauuucuuuuugcauccugucggcgauaccaggguacauggugguaccuccggaaaguacgguguuggcguacaaguccuuacggauaucaacgucacacuucaugauggaguuguagacgguuucguggauaccgcaagauuccauacccaagaaggaagguuggaagagggcuucuggacaacggaaucucucguuaccgauggugaugaccuguccaucgggaaguucguagcucuuuuccaaagagguugaagc

SEQ ID NO: 1497 - RNA, 352 nt, artificial sequence
  synthetic construct
gaucaacgucacacuucaugauggaguuguagacgguuucguggauaccgcaagauuccauacccaagaaggaagguuggaagagggcuucuggacaacggaaucucucguuaccgauggugaugaccuguccaucgggaaguucguagcucuuuuccaaagagguugaagcggcagcgguggccauuuccuguucgaagucgagggcgacauagcaaaguuucuccuugaugucacggacgauuucucuuucagcugugguggugaaugaguaaccucuuucggucaagauuuucaugagguagucggucaaaucacgaccagccaaguccaaacggaggauggcgugggc

SEQ ID NO: 1498 - RNA, 351 nt, artificial sequence
  synthetic construct
ggacagggaagccaagauggauccaccgauccauacggaguauuuccuuucugggggugcgaugaucuugaucuugauggugcuuggagccaaggcggugauuucuuuuugcauccugucggcgauaccaggguacauggugguaccuccggaaaguacgguguuggcguacaaguccuuacggauaucaacgucacacuucaugauggaguuguagacgguuucguggauaccgcaagauuccauacccaagaaggaagguuggaagagggcuucuggacaacggaaucucucguuaccgauggugaugaccuguccaucgggaaguucguagcucuuuuccaaagaggc

SEQ ID NO: 1499 - RNA, 351 nt, artificial sequence
  synthetic construct
guuuucucuguuugccuugggguugaguggagcuucugucaggaggacgggguguucuucuggggcgacacggaguucguuguagaaggugugaugccagaucuuuuccauaucaucccaguuggugaugauaccguguucaaugggguauuucaaugugaggauaccucuuuugcuuugggcuucaucuccuacguaagagucuuuuugucccauuccuaccauuacacccugaugucuugggcguccgacgauggaugggaauacggcacggggcgcgucauccccggcgaaaccggccuugcacauaccggauccauugucuacaacuaaagcggcaacuucuucuuc

SEQ ID NO: 1500 - RNA, 352 nt, artificial sequence
  synthetic construct
guuggauggcuacauacauggcggguguguugaagguuucaaacaugauuugggucaucuuuucucuguuugccuugggguugaguggagcuucugucaggaggacgggguguucuucuggggcgacacggaguucguuguagaaggugugaugccagaucuuuuccauaucaucccaguuggugaugauaccguguucaaugggguauuucaaugugaggauaccucuuuugcuuugggcuucaucuccuacguaagagucuuuuugucccauuccuaccauuacacccugaugucuugggcguccgacgauggaugggaauacggcacggggcgcgucauccccggcgac

SEQ ID NO: 1501 - RNA, 350 nt, artificial sequence
  synthetic construct
ggauucuugagaugcucuucaagaccugcagguccuggagcuacauucuucuuacgcagaccugaaauaucccagacccuaacuguagaauccaaugaagcagaaacuaauaaaucaucaguuggauggaauguagcacacaugacauaaugauugugaccugugaggacacaaaugcaaguccuugauugccaauuccaaauucuuauagucugaucaucagaugcagacacaauccaaggauacucaugauggaacauugugguacgaauguaaucuaaaugacccaauaacguaaaaauacaucguuuuugcuuguaguuccacaccuuuaucuuauaaucaucacc

SEQ ID NO: 1502 - RNA, 352 nt, artificial sequence
  synthetic construct
guucucaauccaaucguauccuuaccgaccucagcuaccuuacaaauauuacacaacacuccuuugaauuuaggcaaguagcugguaccgcacaacggacacuucuccuccgcuuugccccuguauaucggcguguacgaaugaccgcacaaauugaauggauugugcucgucguaaugcaguugaauaucguccgucagauuggaaucgcaggccugcaggauuuuccuagccugcugcgcgacuuccggucuaggacccaguuccagaagucuuuuggcgaacgaagcugcgguuuuauaguuuuugagcuugaaaaacauguucaaagcgguccugagggucaggauuc

SEQ ID NO: 1503 - RNA, 352 nt, artificial sequence
  synthetic construct
guucgaaucauucauucuccacaguuugauuugccuaucaucugccccagaggcuauuaaaggaaguguaggaugaaaugaagcccaguuuacaccacggucaugucccucuaaaacaugcuuaacuacagcaucagcuuguccaaauaaaucaguugaaccaggauucuugagaugcucuucaagaccugcagguccuggagcuacauucuucuuacgcagaccugaaauaucccagacccuaacuguagaauccaaugaagcagaaacuaauaaaucaucaguuggauggaauguagcacacaugacauaaugauugugaccugugaggacacaaaugcaaguccuugac

SEQ ID NO: 1504 - RNA, 352 nt, artificial sequence
  synthetic construct
guacaaauauuacacaacacuccuuugaauuuaggcaaguagcugguaccgcacaacggacacuucuccuccgcuuugccccuguauaucggcguguacgaaugaccgcacaaauugaauggauugugcucgucguaaugcaguugaauaucguccgucagauuggaaucgcaggccugcaggauuuuccuagccugcugcgcgacuuccggucuaggacccaguuccagaagucuuuuggcgaacgaagcugcgguuuuauaguuuuugagcuugaaaaacauguucaaagcgguccugagggucaggauuugauggaugggcuguaauuugcagugcgugaaguaagcgc

SEQ ID NO: 1505 - RNA, 350 nt, artificial sequence
  synthetic construct
gaaaugaugcucugaccaaccaaucgcgaauuucuaaccauguacaagacuucuucguauuugugguugauuaaagccaguuugaauuuguauucgguuggaucgaugaccaauagacgcggcuugcauucccuauccaagcaaaacacuugacuuccccucacucuaguuauguauauaggaagaucgaguguucugaugauuccgugaucgccguuuuuaaggguauacuugaugugauugcugguaguauagauaaauacaccgcuaucgucccaagcuccugauuuuacucgaguauuuucguguaaagagcacaggacgucuaauuuucuauuacaaacugucac

SEQ ID NO: 1506 - RNA, 351 nt, artificial sequence
  synthetic construct
gaaauauuacacaacacuccuuugaauuuaggcaaguagcugguaccgcacaacggacacuucuccuccgcuuugccccuguauaucggcguguacgaaugaccgcacaaauugaauggauugugcucgucguaaugcaguugaauaucguccgucagauuggaaucgcaggccugcaggauuuuccuagccugcugcgcgacuuccggucuaggacccaguuccagaagucuuuuggcgaacgaagcugcgguuuuauaguuuuugagcuugaaaaacauguucaaagcgguccugagggucaggauuugauggaugggcuguaauuugcagugcgugaaguaagcggcc

SEQ ID NO: 1507 - RNA, 352 nt, artificial sequence
  synthetic construct
guuauucucaauccaaucguauccuuaccgaccucagcuaccuuacaaauauuacacaacacuccuuugaauuuaggcaaguagcugguaccgcacaacggacacuucuccuccgcuuugccccuguauaucggcguguacgaaugaccgcacaaauugaauggauugugcucgucguaaugcaguugaauaucguccgucagauuggaaucgcaggccugcaggauuuuccuagccugcugcgcgacuuccggucuaggacccaguuccagaagucuuuuggcgaacgaagcugcgguuuuauaguuuuugagcuugaaaaacauguucaaagcgguccugagggucaggc

SEQ ID NO: 1508 - RNA, 352 nt, artificial sequence
  synthetic construct
guaaaagacauucuguauaccggaauuuuaccuccgccccugauuugcauaacgggcacgucuuuggacgugguaaagucgaguuuucucaaaaaccguucuuuuacguaguacagcagguugccguguaccguauaagcugggcguucucuuucuagcuugaagaugaccauuccaccaucauguccagcagcgaauaaauucagauuaggaugacuggucaugacccaaaaacguucauguucccuucuaaaaguaugcaaacacguccuuuuagccauaucccaaacccugauacuccuaucuucaccauuugauaguagcagcucuugccugggauggaauaauacac

SEQ ID NO: 1509 - RNA, 351 nt, artificial sequence
  synthetic construct
guucuaaccauguacaagacuucuucguauuugugguugauuaaagccaguuugaauuuguauucgguuggaucgaugaccaauagacgcggcuugcauucccuauccaagcaaaacacuugacuuccccucacucuaguuauguauauaggaagaucgaguguucugaugauuccgugaucgccguuuuuaaggguauacuugaugugauugcugguaguauagauaaauacaccgcuaucgucccaagcuccugauuuuacucgaguauuuucguguaaagagcacaggacgucuaauuuucuauuacaaacugucacauuauguuuggagagaagcgccaagugcgac

SEQ ID NO: 1510 - RNA, 351 nt, artificial sequence
  synthetic construct
gaggauucuugagaugcucuucaagaccugcagguccuggagcuacauucuucuuacgcagaccugaaauaucccagacccuaacuguagaauccaaugaagcagaaacuaauaaaucaucaguuggauggaauguagcacacaugacauaaugauugugaccugugaggacacaaaugcaaguccuugauugccaauuccaaauucuuauagucugaucaucagaugcagacacaauccaaggauacucaugauggaacauugugguacgaauguaaucuaaaugacccaauaacguaaaaauacaucguuuuugcuuguaguuccacaccuuuaucuuauaaucaucac

SEQ ID NO: 1511 - RNA, 352 nt, artificial sequence
  synthetic construct
guaguauagauaaauacaccgcuaucgucccaagcuccugauuuuacucgaguauuuucguguaaagagcacaggacgucuaauuuucuauuacaaacugucacauuauguuuggagagaagcgccaagugcgacauauccgaugaccagaccacguaucugcauuuauuuauuuuaacuugagccaaaguccuuuucuguuguacgucgaacaacguuacguguuccgaaucucuaagcaguagcaugccggugccggcauaaaaaacuucaucgcacgugggaguuuggaccuuuuuggugacuucguucuuuaaauucuugaugaucaauugguggguccuaucuaagc

SEQ ID NO: 1512 - RNA, 352 nt, artificial sequence
  synthetic construct
guaaucguaaugaugauagcucgucuaucagcuucgaacgccaaaauuucgcacauggaaucagccgugguuccaccgauugccuugcaaaaaguccagaacgcuuccaaguaggccuuguacaaaguguuucugaugauuucgauguucauuucguccaaauccuguucgcugaugcaaucuacaaagaauggagccagcggcgugucuacuaagacagcguuguauaacucugcuggcguugcggcuacguguauagcuuccauuuguucaaagcugccuaauggaugacauuuuggaaucaguucaccaauaggucuuugaugcaauguuccaguaaucaacagaauac

SEQ ID NO: 1513 - RNA, 352 nt, artificial sequence
  synthetic construct
guuucgcacauggaaucagccgugguuccaccgauugccuugcaaaaaguccagaacgcuuccaaguaggccuuguacaaaguguuucugaugauuucgauguucauuucguccaaauccuguucgcugaugcaaucuacaaagaauggagccagcggcgugucuacuaagacagcguuguauaacucugcuggcguugcggcuacguguauagcuuccauuuguucaaagcugccuaauggaugacauuuuggaaucaguucaccaauaggucuuugaugcaauguuccaguaaucaacagaauaauauugucaaucauauaacuguagguaaugaaguccaagaagguac

SEQ ID NO: 1514 - RNA, 352 nt, artificial sequence
  synthetic construct
guuacgcauaugcugaaacucgaucacaaguuuuucccucaaucuggagucgauggucgacaccgccaagggcgagggcucguuagccaagaaaguuccguaaucgguaccuuguaaaugcaguuucaaaucuucaagggucucgcacugaacuaaauuuagauagucgcuuuguuucaggauuccgcacuugaauccacgacauaauccuucuaaauauccguugucgauguuguaaagacagcccuucaugauuguaguugauuuuguaaguugucuuggagaaguacgaagaacuguacaaaaaaacucacgagaugaaaacaccucaccccaaaugucauaugauauc

SEQ ID NO: 1515 - RNA, 352 nt, artificial sequence
  synthetic construct
guuucaaguaugaauaaaacaccccaaaguggaacugcugcaugaaagcguugauguugagacgcaccucguacucgaagaacuuauccuccaaaguuuuaucgccgggauuguuuccggcgccuucaaacagcuuagaauacucagcauaauacucggcaauagcuuugaccugcucguaauccucagcucuagccagagcagcuaacccaucgggaugcagucuuccgcaacguggauacaauuuagcucuaucguccuugcuaagcuccguaccgaaagaguuaaucguaaugaugauagcucgucuaucagcuucgaacgccaaaauuucgcacauggaaucagccgc

SEQ ID NO: 1516 - RNA, 351 nt, artificial sequence
  synthetic construct
guagaaaauagggauguaauuaucaaucuuggcucuguguuuuugagccacgcacucggaaauccauacaauauuccugcacuccugcuccuugaguuucaaguaugaauaaaacaccccaaaguggaacugcugcaugaaagcguugauguugagacgcaccucguacucgaagaacuuauccuccaaaguuuuaucgccgggauuguuuccggcgccuucaaacagcuuagaauacucagcauaauacucggcaauagcuuugaccugcucguaauccucagcucuagccagagcagcuaacccaucgggaugcagucuuccgcaacguggauacaauuuagcucuauc

SEQ ID NO: 1517 - RNA, 351 nt, artificial sequence
  synthetic construct
gagggauguaauuaucaaucuuggcucuguguuuuugagccacgcacucggaaauccauacaauauuccugcacuccugcuccuugaguuucaaguaugaauaaaacaccccaaaguggaacugcugcaugaaagcguugauguugagacgcaccucguacucgaagaacuuauccuccaaaguuuuaucgccgggauuguuuccggcgccuucaaacagcuuagaauacucagcauaauacucggcaauagcuuugaccugcucguaauccucagcucuagccagagcagcuaacccaucgggaugcagucuuccgcaacguggauacaauuuagcucuaucguccuugc

SEQ ID NO: 1518 - RNA, 351 nt, artificial sequence
  synthetic construct
gauccauacaauauuccugcacuccugcuccuugaguuucaaguaugaauaaaacaccccaaaguggaacugcugcaugaaagcguugauguugagacgcaccucguacucgaagaacuuauccuccaaaguuuuaucgccgggauuguuuccggcgccuucaaacagcuuagaauacucagcauaauacucggcaauagcuuugaccugcucguaauccucagcucuagccagagcagcuaacccaucgggaugcagucuuccgcaacguggauacaauuuagcucuaucguccuugcuaagcuccguaccgaaagaguuaaucguaaugaugauagcucgucuaucagc

SEQ ID NO: 1519 - RNA, 351 nt, artificial sequence
  synthetic construct
guuucgauguucauuucguccaaauccuguucgcugaugcaaucuacaaagaauggagccagcggcgugucuacuaagacagcguuguauaacucugcuggcguugcggcuacguguauagcuuccauuuguucaaagcugccuaauggaugacauuuuggaaucaguucaccaauaggucuuugaugcaauguuccaguaaucaacagaauaauauugucaaucauauaacuguagguaaugaaguccaagaagguagacagaggcucuacggcuugauuacgcauaugcugaaacucgaucacaaguuuuucccucaaucuggagucgauggucgacaccgccaagggc

SEQ ID NO: 1520 - RNA, 352 nt, artificial sequence
  synthetic construct
guacaauauuccugcacuccugcuccuugaguuucaaguaugaauaaaacaccccaaaguggaacugcugcaugaaagcguugauguugagacgcaccucguacucgaagaacuuauccuccaaaguuuuaucgccgggauuguuuccggcgccuucaaacagcuuagaauacucagcauaauacucggcaauagcuuugaccugcucguaauccucagcucuagccagagcagcuaacccaucgggaugcagucuuccgcaacguggauacaauuuagcucuaucguccuugcuaagcuccguaccgaaagaguuaaucguaaugaugauagcucgucuaucagcuucgac

SEQ ID NO: 1521 - RNA, 352 nt, artificial sequence
  synthetic construct
gaucaucgucuuuaucuugcauuucuuuuaauuucuucuuagccaaaucuacccuguccaacuucaaaagaaugucaauaauaaaagcaugugcuuccaaacauucugacgcauguaauacuuuauaugcucccuccagauugccuucauugacguaaauaguggcagcaaccaaaaucagagugucauuauuggcauuuguggcuacuuguuggucaacuugggcuaccacugcuucuuuauuauuuuuuccugauagauaaucagcuaauaguuucagugguugaauuucgaucggagaugcuccaugaauuucaucuaauaccaccaaaaacuuauuuugugccauguc

SEQ ID NO: 1522 - RNA, 352 nt, artificial sequence
  synthetic construct
guuaaaguagcaucaucgucuuuaucuugcauuucuuuuaauuucuucuuagccaaaucuacccuguccaacuucaaaagaaugucaauaauaaaagcaugugcuuccaaacauucugacgcauguaauacuuuauaugcucccuccagauugccuucauugacguaaauaguggcagcaaccaaaaucagagugucauuauuggcauuuguggcuacuuguuggucaacuugggcuaccacugcuucuuuauuauuuuuuccugauagauaaucagcuaauaguuucagugguugaauuucgaucggagaugcuccaugaauuucaucuaauaccaccaaaaacuuauuuc

SEQ ID NO: 1523 - RNA, 352 nt, artificial sequence
  synthetic construct
guaaaugugacagcuugaccguucagaagaagugguguugaaccauauuugucaaccaauucuugguaaauguaguaagcaucuugaaguuuaucaccaccaguuugaauguugauccaagccugugccaguugaguuaaaguagcaucaucgucuuuaucuugcauuucuuuuaauuucuucuuagccaaaucuacccuguccaacuucaaaagaaugucaauaauaaaagcaugugcuuccaaacauucugacgcauguaauacuuuauaugcucccuccagauugccuucauugacguaaauaguggcagcaaccaaaaucagagugucauuauuggcauuuguggcuc

SEQ ID NO: 1524 - RNA, 352 nt, artificial sequence
  synthetic construct
guaaaguagcaucaucgucuuuaucuugcauuucuuuuaauuucuucuuagccaaaucuacccuguccaacuucaaaagaaugucaauaauaaaagcaugugcuuccaaacauucugacgcauguaauacuuuauaugcucccuccagauugccuucauugacguaaauaguggcagcaaccaaaaucagagugucauuauuggcauuuguggcuacuuguuggucaacuugggcuaccacugcuucuuuauuauuuuuuccugauagauaaucagcuaauaguuucagugguugaauuucgaucggagaugcuccaugaauuucaucuaauaccaccaaaaacuuauuuuc

SEQ ID NO: 1525 - RNA, 351 nt, artificial sequence
  synthetic construct
guagcaucaucgucuuuaucuugcauuucuuuuaauuucuucuuagccaaaucuacccuguccaacuucaaaagaaugucaauaauaaaagcaugugcuuccaaacauucugacgcauguaauacuuuauaugcucccuccagauugccuucauugacguaaauaguggcagcaaccaaaaucagagugucauuauuggcauuuguggcuacuuguuggucaacuugggcuaccacugcuucuuuauuauuuuuuccugauagauaaucagcuaauaguuucagugguugaauuucgaucggagaugcuccaugaauuucaucuaauaccaccaaaaacuuauuuugugcc

SEQ ID NO: 1526 - RNA, 351 nt, artificial sequence
  synthetic construct
gcuggauaauuggcaucuuuaucgauagccucuugcaaagcugccucugccucuucauauuuugcuugaccuauaaaugugacagcuugaccguucagaagaagugguguugaaccauauuugucaaccaauucuugguaaauguaguaagcaucuugaaguuuaucaccaccaguuugaauguugauccaagccugugccaguugaguuaaaguagcaucaucgucuuuaucuugcauuucuuuuaauuucuucuuagccaaaucuacccuguccaacuucaaaagaaugucaauaauaaaagcaugugcuuccaaacauucugacgcauguaauacuuuauaugcuccc

SEQ ID NO: 1527 - RNA, 352 nt, artificial sequence
  synthetic construct
guaaauaucuguuugcaaucucaggaccuuugcccauaugccucugaaggguaauaaaauuaaccaauguaucuggauaauuggcaucuuuaucgauagccucuugcaaagcugccucugccucuucauauuuugcuugaccuauaaaugugacagcuugaccguucagaagaagugguguugaaccauauuugucaaccaauucuugguaaauguaguaagcaucuugaaguuuaucaccaccaguuugaauguugauccaagccugugccaguugaguuaaaguagcaucaucgucuuuaucuugcauuucuuuuaauuucuucuuagccaaaucuacccuguccaacuc

SEQ ID NO: 1528 - RNA, 352 nt, artificial sequence
  synthetic construct
guuugaauguugauccaagccugugccaguugaguuaaaguagcaucaucgucuuuaucuugcauuucuuuuaauuucuucuuagccaaaucuacccuguccaacuucaaaagaaugucaauaauaaaagcaugugcuuccaaacauucugacgcauguaauacuuuauaugcucccuccagauugccuucauugacguaaauaguggcagcaaccaaaaucagagugucauuauuggcauuuguggcuacuuguuggucaacuugggcuaccacugcuucuuuauuauuuuuuccugauagauaaucagcuaauaguuucagugguugaauuucgaucggagaugcuccac

SEQ ID NO: 1529 - RNA, 351 nt, artificial sequence
  synthetic construct
guuugucaaccaauucuugguaaauguaguaagcaucuugaaguuuaucaccaccaguuugaauguugauccaagccugugccaguugaguuaaaguagcaucaucgucuuuaucuugcauuucuuuuaauuucuucuuagccaaaucuacccuguccaacuucaaaagaaugucaauaauaaaagcaugugcuuccaaacauucugacgcauguaauacuuuauaugcucccuccagauugccuucauugacguaaauaguggcagcaaccaaaaucagagugucauuauuggcauuuguggcuacuuguuggucaacuugggcuaccacugcuucuuuauuauuuuuuc

SEQ ID NO: 1530 - RNA, 351 nt, artificial sequence
  synthetic construct
guuuuaauuucuucuuagccaaaucuacccuguccaacuucaaaagaaugucaauaauaaaagcaugugcuuccaaacauucugacgcauguaauacuuuauaugcucccuccagauugccuucauugacguaaauaguggcagcaaccaaaaucagagugucauuauuggcauuuguggcuacuuguuggucaacuugggcuaccacugcuucuuuauuauuuuuuccugauagauaaucagcuaauaguuucagugguugaauuucgaucggagaugcuccaugaauuucaucuaauaccaccaaaaacuuauuuugugccauguaggaucuauaagugaagauaucuc

SEQ ID NO: 1531 - RNA, 352 nt, artificial sequence
  synthetic construct
gucaacuugggcuaccacugcuucuuuauuauuuuuuccugauagauaaucagcuaauaguuucagugguugaauuucgaucggagaugcuccaugaauuucaucuaauaccaccaaaaacuuauuuugugccauguaggaucuauaagugaagauaucucuuuggguagcaacuucuggaguugagggcuuuuuuaauuuuugagcuucguugauacauugcugguaguuuccuauauagaaauaauuuuuuauuucgaaaaguucgucuacgucuugcugcugacgugccauuuuuguuaugacguuugugugacgugugacguuuaaauaauuuuucaucuucuuguuc

SEQ ID NO: 1532 - RNA, 351 nt, artificial sequence
  synthetic construct
guacacuacuucguauuuuucuggauagagugcagucuccacggaauauuuaauaggagaaucaucaucgacaaggacuacuucgguuaucuuaauacuagcguaggaugauuuggaauugaauccgaccgacagcgggaagaaaucauugggaauggcucucggugcauugaauucuaacgacccagucuuguuacuagcgucaauaagcggcaaauuccaaaccagaugauuucuuuuagcuucauguguguauguaccaucacauucgccuacuaugggcgagcaaccgauuggcaauggaauuguaauauugacaucgaccaauuccaaauugaugugggcaaguuc

SEQ ID NO: 1533 - RNA, 352 nt, artificial sequence
  synthetic construct
guuucuugagucugucuaacagcuugauaaacuuuuucuucaugugaauccauuucgacaaaagugcggauuugagacagauugacacuuucccuauaaccuagagcuacaauuucaucaaaagcaaauauaagagaaaaggcauuuucagcuauuucauuuucaucuaaagaccuacaauauucuggaauaacucuugcaaauagacguagggucuccagaucuucuaauauauuacuagcucuaguugugaugagcaacauguauagucuuucuaaagguugauacacguaacgcacugaaucuguuucaacaaaaguguguugugucccaguuggaauuaacuuugggc

SEQ ID NO: 1534 - RNA, 351 nt, artificial sequence
  synthetic construct
gacuacuucgguuaucuuaauacuagcguaggaugauuuggaauugaauccgaccgacagcgggaagaaaucauugggaauggcucucggugcauugaauucuaacgacccagucuuguuacuagcgucaauaagcggcaaauuccaaaccagaugauuucuuuuagcuucauguguguauguaccaucacauucgccuacuaugggcgagcaaccgauuggcaauggaauuguaauauugacaucgaccaauuccaaauugaugugggcaaguucguauucgauguugacgucacaacugccgucgccagcuucugagggccaacaguugauuaauagaggcacuaaggc

SEQ ID NO: 1535 - RNA, 352 nt, artificial sequence
  synthetic construct
guuucucuuccaaucucaaguggacgucaucaauaucaguuuuaauagcaggugcuuuaguuccugguugcgagaugcuguuuuuauuuggaguuaugacguuuucuccuucagauuucaauugauccacaaaagauuccacaucucuacccuuuccgccuaguuucauaccacgagguuuuugugcagggguggcuguauaugaaggcggcuuaacaucguugaccugguuagcgauaucuccaauagauggcgucggaguauaaccgguggaacuaccaaaaccaccgcuguugcugaacgcagguuugccacccuucuuuugugcuuccauuuucugccuuugcaauuc

SEQ ID NO: 1536 - RNA, 351 nt, artificial sequence
  synthetic construct
guucucuuccaaucucaaguggacgucaucaauaucaguuuuaauagcaggugcuuuaguuccugguugcgagaugcuguuuuuauuuggaguuaugacguuuucuccuucagauuucaauugauccacaaaagauuccacaucucuacccuuuccgccuaguuucauaccacgagguuuuugugcagggguggcuguauaugaaggcggcuuaacaucguugaccugguuagcgauaucuccaauagauggcgucggaguauaaccgguggaacuaccaaaaccaccgcuguugcugaacgcagguuugccacccuucuuuugugcuuccauuuucugccuuugcaauuc

SEQ ID NO: 1537 - RNA, 352 nt, artificial sequence
  synthetic construct
guuuuucuucaugugaauccauuucgacaaaagugcggauuugagacagauugacacuuucccuauaaccuagagcuacaauuucaucaaaagcaaauauaagagaaaaggcauuuucagcuauuucauuuucaucuaaagaccuacaauauucuggaauaacucuugcaaauagacguagggucuccagaucuucuaauauauuacuagcucuaguugugaugagcaacauguauagucuuucuaaagguugauacacguaacgcacugaaucuguuucaacaaaaguguguugugucccaguuggaauuaacuuugggaaagcagcuaguagaccuucaauacgugcuuc

SEQ ID NO: 1538 - RNA, 352 nt, artificial sequence
  synthetic construct
gauuucauuuucaucuaaagaccuacaauauucuggaauaacucuugcaaauagacguagggucuccagaucuucuaauauauuacuagcucuaguugugaugagcaacauguauagucuuucuaaagguugauacacguaacgcacugaaucuguuucaacaaaaguguguugugucccaguuggaauuaacuuugggaaagcagcuaguagaccuucaauacgugcuuuggucauuucaacaaacugucuagauacaauuguuuugccugcuuucgugcagacugcugcugcaauuaguaccauuguaauuucguuuaaauggcacaaauuuacuaaaauauuauuauuc

SEQ ID NO: 1539 - RNA, 351 nt, artificial sequence
  synthetic construct
gaauuggacucguauucugccccaucuaucaucgccuaugugcaacgucgccaugccuaauauuucgaauuguugcacuccuccaucacgacccauucuggcgaucaguuucucuuccaaucucaaguggacgucaucaauaucaguuuuaauagcaggugcuuuaguuccugguugcgagaugcuguuuuuauuuggaguuaugacguuuucuccuucagauuucaauugauccacaaaagauuccacaucucuacccuuuccgccuaguuucauaccacgagguuuuugugcagggguggcuguauaugaaggcggcuuaacaucguugaccugguuagcgauaucucc

SEQ ID NO: 1540 - RNA, 352 nt, artificial sequence
  synthetic construct
guuugagacagauugacacuuucccuauaaccuagagcuacaauuucaucaaaagcaaauauaagagaaaaggcauuuucagcuauuucauuuucaucuaaagaccuacaauauucuggaauaacucuugcaaauagacguagggucuccagaucuucuaauauauuacuagcucuaguugugaugagcaacauguauagucuuucuaaagguugauacacguaacgcacugaaucuguuucaacaaaaguguguugugucccaguuggaauuaacuuugggaaagcagcuaguagaccuucaauacgugcuuuggucauuucaacaaacugucuagauacaauuguuuugc

SEQ ID NO: 1541 - RNA, 352 nt, artificial sequence
  synthetic construct
guucuucuaauaacuguuccauaguauugacaugugugcaccacagacuaagucuggauaccaugcuggauauuugagucuuguccaaaacucuagguuggacccaugucauauuuacaguacuggcaaccugaucaauagcaccuuuaacgagaccuugagaaagugccuucaugaccagaaguucaauuucauuaagagguaauuuaguuucuuuugaaauuucagcaaaaguuaguugucuguugugagauggucugcuaaaggucaucuccaucagacacaacaaagauaucuuuugucucaaaaagagcuccucagcagcuagaucugcuaugccagcccauugugc

SEQ ID NO: 1542 - RNA, 352 nt, artificial sequence
  synthetic construct
guuucauagcuucaaaucucuuuaugucaccagaauugaaagcauacaaaaguucaauuaaccaagcauuuucuguugauuucaaagagucuaacacagggugagccaguaauucuccaagauuguacacaccuucgcccaacagagcugccaaucccaaaaaaaaugcauguuguacuuugacaucggauuuuaaaguguccagcucuaugcaacccaaauaccucaaggcaguucuguaauauugugcaugguccccuugaauucgauaauauugagaggccaguaaauaaaaccugccaugcacagguguaacuccaucugcguugucuagaguggcuucgacuuccuc

SEQ ID NO: 1543 - RNA, 350 nt, artificial sequence
  synthetic construct
guguaacuccaucugcguugucuagaguggcuucgacuuccucuauaaucuuuuugguggcaucuaaaucguuuaacuuuucgagauaaauuuggcccuccaaaacuuugcagagauuuugugcaucuggauugauuuuaacuuuagguucagucuucucuaagaaagugauugcauccuuagguucuuuauauuguucgacgacaauagccgcuauuucaaccaaagacaaaggauugauuuuauuuucgaaggauugaaugaaauugugauaaaguugaauuagguugucgccuuuuuguaauuccgguuuuuuaauaaaaacgaguaauuuuaauguuaauugaugc

SEQ ID NO: 1544 - RNA, 352 nt, artificial sequence
  synthetic construct
guacaaaaguucaauuaaccaagcauuuucuguugauuucaaagagucuaacacagggugagccaguaauucuccaagauuguacacaccuucgcccaacagagcugccaaucccaaaaaaaaugcauguuguacuuugacaucggauuuuaaaguguccagcucuaugcaacccaaauaccucaaggcaguucuguaauauugugcaugguccccuugaauucgauaauauugagaggccaguaaauaaaaccugccaugcacagguguaacuccaucugcguugucuagaguggcuucgacuuccucuauaaucuuuuugguggcaucuaaaucguuuaacuuuucgagc

SEQ ID NO: 1545 - RNA, 351 nt, artificial sequence
  synthetic construct
guucauagcuucaaaucucuuuaugucaccagaauugaaagcauacaaaaguucaauuaaccaagcauuuucuguugauuucaaagagucuaacacagggugagccaguaauucuccaagauuguacacaccuucgcccaacagagcugccaaucccaaaaaaaaugcauguuguacuuugacaucggauuuuaaaguguccagcucuaugcaacccaaauaccucaaggcaguucuguaauauugugcaugguccccuugaauucgauaauauugagaggccaguaaauaaaaccugccaugcacagguguaacuccaucugcguugucuagaguggcuucgacuuccuc

SEQ ID NO: 1546 - RNA, 352 nt, artificial sequence
  synthetic construct
guuuuucuucuaauaacuguuccauaguauugacaugugugcaccacagacuaagucuggauaccaugcuggauauuugagucuuguccaaaacucuagguuggacccaugucauauuuacaguacuggcaaccugaucaauagcaccuuuaacgagaccuugagaaagugccuucaugaccagaaguucaauuucauuaagagguaauuuaguuucuuuugaaauuucagcaaaaguuaguugucuguugugagauggucugcuaaaggucaucuccaucagacacaacaaagauaucuuuugucucaaaaagagcuccucagcagcuagaucugcuaugccagcccauuc

SEQ ID NO: 1547 - RNA, 351 nt, artificial sequence
  synthetic construct
gcuucaaaucucuuuaugucaccagaauugaaagcauacaaaaguucaauuaaccaagcauuuucuguugauuucaaagagucuaacacagggugagccaguaauucuccaagauuguacacaccuucgcccaacagagcugccaaucccaaaaaaaaugcauguuguacuuugacaucggauuuuaaaguguccagcucuaugcaacccaaauaccucaaggcaguucuguaauauugugcaugguccccuugaauucgauaauauugagaggccaguaaauaaaaccugccaugcacagguguaacuccaucugcguugucuagaguggcuucgacuuccucuauaauc

SEQ ID NO: 1548 - RNA, 351 nt, artificial sequence
  synthetic construct
gacccaugucauauuuacaguacuggcaaccugaucaauagcaccuuuaacgagaccuugagaaagugccuucaugaccagaaguucaauuucauuaagagguaauuuaguuucuuuugaaauuucagcaaaaguuaguugucuguugugagauggucugcuaaaggucaucuccaucagacacaacaaagauaucuuuugucucaaaaagagcuccucagcagcuagaucugcuaugccagcccauuguguuuucauagcuucaaaucucuuuaugucaccagaauugaaagcauacaaaaguucaauuaaccaagcauuuucuguugauuucaaagagucuaacacagc

SEQ ID NO: 1549 - RNA, 352 nt, artificial sequence
  synthetic construct
guuucacuugcuuuuucuucuaauaacuguuccauaguauugacaugugugcaccacagacuaagucuggauaccaugcuggauauuugagucuuguccaaaacucuagguuggacccaugucauauuuacaguacuggcaaccugaucaauagcaccuuuaacgagaccuugagaaagugccuucaugaccagaaguucaauuucauuaagagguaauuuaguuucuuuugaaauuucagcaaaaguuaguugucuguugugagauggucugcuaaaggucaucuccaucagacacaacaaagauaucuuuugucucaaaaagagcuccucagcagcuagaucugcuaugc

SEQ ID NO: 1550 - RNA, 351 nt, artificial sequence
  synthetic construct
guuugucucaaaaagagcuccucagcagcuagaucugcuaugccagcccauuguguuuucauagcuucaaaucucuuuaugucaccagaauugaaagcauacaaaaguucaauuaaccaagcauuuucuguugauuucaaagagucuaacacagggugagccaguaauucuccaagauuguacacaccuucgcccaacagagcugccaaucccaaaaaaaaugcauguuguacuuugacaucggauuuuaaaguguccagcucuaugcaacccaaauaccucaaggcaguucuguaauauugugcaugguccccuugaauucgauaauauugagaggccaguaaauaaaac

SEQ ID NO: 1551 - RNA, 352 nt, artificial sequence
  synthetic construct
guggcccuccaaaacuuugcagagauuuugugcaucuggauugauuuuaacuuuagguucagucuucucuaagaaagugauugcauccuuagguucuuuauauuguucgacgacaauagccgcuauuucaaccaaagacaaaggauugauuuuauuuucgaaggauugaaugaaauugugauaaaguugaauuagguugucgccuuuuuguaauuccgguuuuuuaauaaaaacgaguaauuuuaauguuaauugaugccauaauuuuuuauuaugaaguuccucgaguucggcccauucggaaccuaauucuuuuggacuuucuuguuguuuuuuagauagauaaucacuc

SEQ ID NO: 1552 - RNA, 351 nt, artificial sequence
  synthetic construct
guaaucucuucuucguccuccucuuccgguuccuccacagaggucgcugguaacggcgauacuuucucugcggcgucuugaggcggcagaggggcuucuccuaucuuucccuccguuaucucgaacaaaacuuugucgaucuccgucugcgccgccuccuccauuuccucggaauaaucaaggucuuccaugguuucguccaacauuucuucgauuauacccgccuucaucaucucuuucgacaugucuugcauuguuugggcuaccucgggcacucuaacgagucgcugcaucgcuugcaucaccucuguagacuucuggagggcgccugacacucucaauguagcuaac

SEQ ID NO: 1553 - RNA, 352 nt, artificial sequence
  synthetic construct
guaaucgacucugcauuuccguaaucucuucuucguccuccucuuccgguuccuccacagaggucgcugguaacggcgauacuuucucugcggcgucuugaggcggcagaggggcuucuccuaucuuucccuccguuaucucgaacaaaacuuugucgaucuccgucugcgccgccuccuccauuuccucggaauaaucaaggucuuccaugguuucguccaacauuucuucgauuauacccgccuucaucaucucuuucgacaugucuugcauuguuugggcuaccucgggcacucuaacgagucgcugcaucgcuugcaucaccucuguagacuucuggagggcgccugc

SEQ ID NO: 1554 - RNA, 352 nt, artificial sequence
  synthetic construct
guuuccguaaucucuucuucguccuccucuuccgguuccuccacagaggucgcugguaacggcgauacuuucucugcggcgucuugaggcggcagaggggcuucuccuaucuuucccuccguuaucucgaacaaaacuuugucgaucuccgucugcgccgccuccuccauuuccucggaauaaucaaggucuuccaugguuucguccaacauuucuucgauuauacccgccuucaucaucucuuucgacaugucuugcauuguuugggcuaccucgggcacucuaacgagucgcugcaucgcuugcaucaccucuguagacuucuggagggcgccugacacucucaauguac

SEQ ID NO: 1555 - RNA, 352 nt, artificial sequence
  synthetic construct
gaccucuguagacuucuggagggcgccugacacucucaauguagcuaacugguucuucauuugcaacaucacagaauugaggugagccuucgacguguaaauuuuauuaacagcuuuccuugaauuaauaauuuccuuggccaaaauaaggcagguguccuugucguuuuucuucgcugcaucuuuuaaagaccuuuucacuuuuuccucuucucuuuguauagcuuuaauuugccuaucuaauugguaucccucuuugcgaaguuugugauuccauucuguaaccaaaucuuuaggauuccuuucaggugucuucccaaaaagucccauguuuauuacagauguuuuucuc

SEQ ID NO: 1556 - RNA, 352 nt, artificial sequence
  synthetic construct
gaaucucuucuucguccuccucuuccgguuccuccacagaggucgcugguaacggcgauacuuucucugcggcgucuugaggcggcagaggggcuucuccuaucuuucccuccguuaucucgaacaaaacuuugucgaucuccgucugcgccgccuccuccauuuccucggaauaaucaaggucuuccaugguuucguccaacauuucuucgauuauacccgccuucaucaucucuuucgacaugucuugcauuguuugggcuaccucgggcacucuaacgagucgcugcaucgcuugcaucaccucuguagacuucuggagggcgccugacacucucaauguagcuaacuc

SEQ ID NO: 1557 - RNA, 351 nt, artificial sequence
  synthetic construct
guuucuucgauuauacccgccuucaucaucucuuucgacaugucuugcauuguuugggcuaccucgggcacucuaacgagucgcugcaucgcuugcaucaccucuguagacuucuggagggcgccugacacucucaauguagcuaacugguucuucauuugcaacaucacagaauugaggugagccuucgacguguaaauuuuauuaacagcuuuccuugaauuaauaauuuccuuggccaaaauaaggcagguguccuugucguuuuucuucgcugcaucuuuuaaagaccuuuucacuuuuuccucuucucuuuguauagcuuuaauuugccuaucuaauugguauccc

SEQ ID NO: 1558 - RNA, 352 nt, artificial sequence
  synthetic construct
guaaucaaggucuuccaugguuucguccaacauuucuucgauuauacccgccuucaucaucucuuucgacaugucuugcauuguuugggcuaccucgggcacucuaacgagucgcugcaucgcuugcaucaccucuguagacuucuggagggcgccugacacucucaauguagcuaacugguucuucauuugcaacaucacagaauugaggugagccuucgacguguaaauuuuauuaacagcuuuccuugaauuaauaauuuccuuggccaaaauaaggcagguguccuugucguuuuucuucgcugcaucuuuuaaagaccuuuucacuuuuuccucuucucuuuguauc

SEQ ID NO: 1559 - RNA, 351 nt, artificial sequence
  synthetic construct
gucucguuggaaacgaauuaauuuuauugauucgucgcacauugagacauauaaaucuuugcgaccuuuuuuguaagccuccaaugccgaggugagaagggcgucuuucaugugauuuuucuuaucgucuaaacugucaaggauaaacaucucggcuugggcgcagaaaucaucuucuugaauguauauuucacuuaaagcuuggguauuaugcucuuugcaguauuuaauaaacagggauugagcuacaggaaaauuucuaauagucaucuuaaagucucccaacggcauauuuucucuuaauuucaauauaaccauauacacuaaaucuguaucuccacuuucaaucgc

SEQ ID NO: 1560 - RNA, 351 nt, artificial sequence
  synthetic construct
guugagacauauaaaucuuugcgaccuuuuuuguaagccuccaaugccgaggugagaagggcgucuuucaugugauuuuucuuaucgucuaaacugucaaggauaaacaucucggcuugggcgcagaaaucaucuucuugaauguauauuucacuuaaagcuuggguauuaugcucuuugcaguauuuaauaaacagggauugagcuacaggaaaauuucuaauagucaucuuaaagucucccaacggcauauuuucucuuaauuucaauauaaccauauacacuaaaucuguaucuccacuuucaaucgccuuaacuaacgcugguacguuuucuccuaauucuaaaagc

SEQ ID NO: 1561 - RNA, 351 nt, artificial sequence
  synthetic construct
gaauuuuugaccguguuuaccaacuauuaaaaaaguguugucuuuuucccaauacagaacaacagccucauuaccacaccaaaguaaauguuuuggucuaaaaaccaugucacaaucgauuucgcaguauuuuguccucaaauuuguggaacccaaccacaaaaauccagaauccguaaacaacgccagauggugugcauuuaaugaaacagacauuuuuaugauugauguguauuuguuggugauauccgguucaagcauugcacuugugugguguucaucuuguuucagucuauagaguucuacacuucuugcuauuaaaacuucagucuuaucaucagaaacuauagc

SEQ ID NO: 1562 - RNA, 351 nt, artificial sequence
  synthetic construct
guuuauccucuacgucucguuggaaacgaauuaauuuuauugauucgucgcacauugagacauauaaaucuuugcgaccuuuuuuguaagccuccaaugccgaggugagaagggcgucuuucaugugauuuuucuuaucgucuaaacugucaaggauaaacaucucggcuugggcgcagaaaucaucuucuugaauguauauuucacuuaaagcuuggguauuaugcucuuugcaguauuuaauaaacagggauugagcuacaggaaaauuucuaauagucaucuuaaagucucccaacggcauauuuucucuuaauuucaauauaaccauauacacuaaaucuguaucuc

SEQ ID NO: 1563 - RNA, 351 nt, artificial sequence
  synthetic construct
gacuuuauccucuacgucucguuggaaacgaauuaauuuuauugauucgucgcacauugagacauauaaaucuuugcgaccuuuuuuguaagccuccaaugccgaggugagaagggcgucuuucaugugauuuuucuuaucgucuaaacugucaaggauaaacaucucggcuugggcgcagaaaucaucuucuugaauguauauuucacuuaaagcuuggguauuaugcucuuugcaguauuuaauaaacagggauugagcuacaggaaaauuucuaauagucaucuuaaagucucccaacggcauauuuucucuuaauuucaauauaaccauauacacuaaaucuguauc

SEQ ID NO: 1564 - RNA, 352 nt, artificial sequence
  synthetic construct
guaucagaucucaugucuggaaugaagcauuuaccaaauugugcugcucuuauuaacaauuuuugaacgucagugucaaauucauauccuacugcuucuauacacugguugacugcagucuccagaucauuuuuaacuaaacaaauguauucauuugcuuuauggcuaccuuuuugaaauuguuuugaggcuucuaacagaaaacuaccagggucugugcuguuaauucuaaaaaucuuuugaacaacuucugguacuuuuugaaguaguucauguugcguauucgaaauuauccuaauaccaucuauuucugguaccaaaugaaccgauccaucauaaaaguaacuuaauc

SEQ ID NO: 1565 - RNA, 351 nt, artificial sequence
  synthetic construct
guagucaucuuaaagucucccaacggcauauuuucucuuaauuucaauauaaccauauacacuaaaucuguaucuccacuuucaaucgccuuaacuaacgcugguacguuuucuccuaauucuaaaagcaguuuuacuuggucgcuugcuuuagacucguaaucuagaagcuuuauagccaauuuuuuucucccauauucugaagcaguacuggcaauuucacuguaagaaaugccugaagaguaccccaacuuuucagcaauuucccuagcuaccguuucuuccucuaaaugugacuggcugaccuuauauuuugcccaguggaccaaaauauagcuuguuccgucuucc

SEQ ID NO: 1566 - RNA, 352 nt, artificial sequence
  synthetic construct
guucaauacucucaaaagucuacacauauuuacauaacuaucagaucucaugucuggaaugaagcauuuaccaaauugugcugcucuuauuaacaauuuuugaacgucagugucaaauucauauccuacugcuucuauacacugguugacugcagucuccagaucauuuuuaacuaaacaaauguauucauuugcuuuauggcuaccuuuuugaaauuguuuugaggcuucuaacagaaaacuaccagggucugugcuguuaauucuaaaaaucuuuugaacaacuucugguacuuuuugaaguaguucauguugcguauucgaaauuauccuaauaccaucuauuucuggc

SEQ ID NO: 1567 - RNA, 352 nt, artificial sequence
  synthetic construct
gucuuguauacaaagaaguucuucaucauuuguccagcccaugugaacaaugggccgucuacuccacuugaaugaagcuaucuguuugccagauccagaaaaaauggaaauaauugguuguccagaccccugcacuuuaagaaucuuuuggucaucucuucuaauggcuauagggccuccguaagaagccgaagaugcuauauaauucucuauauuaacuucuugaugccaugacauagaauauauuucaaauuuucuguaauaugcaucucuucccaguaagaaccauucugccguuagcauugcagcagacauuuugauaaaaauuaaaggaaaauaauuguaauauauc

SEQ ID NO: 1568 - RNA, 351 nt, artificial sequence
  synthetic construct
guaugcucuuugcaguauuuaauaaacagggauugagcuacaggaaaauuucuaauagucaucuuaaagucucccaacggcauauuuucucuuaauuucaauauaaccauauacacuaaaucuguaucuccacuuucaaucgccuuaacuaacgcugguacguuuucuccuaauucuaaaagcaguuuuacuuggucgcuugcuuuagacucguaaucuagaagcuuuauagccaauuuuuuucucccauauucugaagcaguacuggcaauuucacuguaagaaaugccugaagaguaccccaacuuuucagcaauuucccuagcuaccguuucuuccucuaaaugugac

SEQ ID NO: 1569 - RNA, 352 nt, artificial sequence
  synthetic construct
guuucuuaucgucuaaacugucaaggauaaacaucucggcuugggcgcagaaaucaucuucuugaauguauauuucacuuaaagcuuggguauuaugcucuuugcaguauuuaauaaacagggauugagcuacaggaaaauuucuaauagucaucuuaaagucucccaacggcauauuuucucuuaauuucaauauaaccauauacacuaaaucuguaucuccacuuucaaucgccuuaacuaacgcugguacguuuucuccuaauucuaaaagcaguuuuacuuggucgcuugcuuuagacucguaaucuagaagcuuuauagccaauuuuuuucucccauauucugaagc

SEQ ID NO: 1570 - RNA, 350 nt, artificial sequence
  synthetic construct
guagcccuaggguguaaccuagcauagcauuugcgacagaucaucuugucgcaguuguauuucugagcuaggagacgcagagagggcucgaugauaccuccucucaaacggagcaccaaaugaaggguggauucuuucuggauauuauagucugaaagaguacguccaucuucgaguuguuuuccagcgaagauuaaucgcugcuggucaggagggauaccuuccuuguccuggaucuuugcuuuuacauuuucuauaguaucugauggcucuaccucgaggguaaugguuuuaccugugagaguuuucacgaaaauuugcauuguggaaggugguguuccgcaacgugc

SEQ ID NO: 1571 - RNA, 351 nt, artificial sequence
  synthetic construct
guacuucagcuucuucuuggggcgcaaguuguuuguguguccacacuugguuuuccugcaauuaguagcccuaggguguaaccuagcauagcauuugcgacagaucaucuugucgcaguuguauuucugagcuaggagacgcagagagggcucgaugauaccuccucucaaacggagcaccaaaugaaggguggauucuuucuggauauuauagucugaaagaguacguccaucuucgaguuguuuuccagcgaagauuaaucgcugcuggucaggagggauaccuuccuuguccuggaucuuugcuuuuacauuuucuauaguaucugauggcucuaccucgaggguaac

SEQ ID NO: 1572 - RNA, 352 nt, artificial sequence
  synthetic construct
guuuuccugcaauuaguagcccuaggguguaaccuagcauagcauuugcgacagaucaucuugucgcaguuguauuucugagcuaggagacgcagagagggcucgaugauaccuccucucaaacggagcaccaaaugaaggguggauucuuucuggauauuauagucugaaagaguacguccaucuucgaguuguuuuccagcgaagauuaaucgcugcuggucaggagggauaccuuccuuguccuggaucuuugcuuuuacauuuucuauaguaucugauggcucuaccucgaggguaaugguuuuaccugugagaguuuucacgaaaauuugcauuguggaaggugguc

SEQ ID NO: 1573 - RNA, 352 nt, artificial sequence
  synthetic construct
guucuuccuuaacucuauccuucuugagcggacccaugaaggcggccuuaucggcggcggucuggaaucuaccguguccaaauuuagacgagguaucaaugaauuucaaauugaucuucuccaaagcgacacguuugguguggaccaacaaggacuuucugagggugaugacacgcuucuuggguccuauacaacaucccuugaucaugacgaagucauuguucacuucaccauagugagggaaaccucccauuggaguaaugguuuucucacuaagaucauaagcaguggaagcauuguucuugacgaccuuuccaucuuugguguggauuccggcuccgauucuguaaac

SEQ ID NO: 1574 - RNA, 352 nt, artificial sequence
  synthetic construct
guuaucuucuuccuuaacucuauccuucuugagcggacccaugaaggcggccuuaucggcggcggucuggaaucuaccguguccaaauuuagacgagguaucaaugaauuucaaauugaucuucuccaaagcgacacguuugguguggaccaacaaggacuuucugagggugaugacacgcuucuuggguccuauacaacaucccuugaucaugacgaagucauuguucacuucaccauagugagggaaaccucccauuggaguaaugguuuucucacuaagaucauaagcaguggaagcauuguucuugacgaccuuuccaucuuugguguggauuccggcuccgauucuc

SEQ ID NO: 1575 - RNA, 352 nt, artificial sequence
  synthetic construct
guuccuuaacucuauccuucuugagcggacccaugaaggcggccuuaucggcggcggucuggaaucuaccguguccaaauuuagacgagguaucaaugaauuucaaauugaucuucuccaaagcgacacguuugguguggaccaacaaggacuuucugagggugaugacacgcuucuuggguccuauacaacaucccuugaucaugacgaagucauuguucacuucaccauagugagggaaaccucccauuggaguaaugguuuucucacuaagaucauaagcaguggaagcauuguucuugacgaccuuuccaucuuugguguggauuccggcuccgauucuguaaaucuc

SEQ ID NO: 1576 - RNA, 352 nt, artificial sequence
  synthetic construct
gucucacuaagaucauaagcaguggaagcauuguucuugacgaccuuuccaucuuugguguggauuccggcuccgauucuguaaaucuucuuguucaucucaguucugugaugguaaccuuucugaccagcacgggcuacggugaacgauacacgagaaggaugccacgcuccaauacaagcaacuuuacgaagacccuugugcguuuugcggggcaacuucuuugugugccaacgagaaguaacaccuuuguauccaugacccuuggugacaccaaugcagucaaucaucucaucuugggcaaagacguuggcaacagggauugguuuuucaagauguucccuggcccauc

SEQ ID NO: 1577 - RNA, 352 nt, artificial sequence
  synthetic construct
gaugaucuucuucaagucgcguucaauggacuucuuaccuagaucaucaguccauuucuuagaugccuuagugaaggccuucuuuuugcucuuguaccaguucuuguagaagcgucugcgacagucuucagauaaaugcucagcccaaacuguggccaaagcccuaagaccauguggaguuucaauauaaccaacuacuccuacaacaaccauuggaggaguuuccaaaaugguaacagccucuacgauuucuuucuuauuuauuuuugaaccgggccugucugcuucucuuacaacgugggucauaccagcuuuauaaccgauaaaagcgguuaaauggacagguuucgac

SEQ ID NO: 1578 - RNA, 352 nt, artificial sequence
  synthetic construct
guaucuucuuccuuaacucuauccuucuugagcggacccaugaaggcggccuuaucggcggcggucuggaaucuaccguguccaaauuuagacgagguaucaaugaauuucaaauugaucuucuccaaagcgacacguuugguguggaccaacaaggacuuucugagggugaugacacgcuucuuggguccuauacaacaucccuugaucaugacgaagucauuguucacuucaccauagugagggaaaccucccauuggaguaaugguuuucucacuaagaucauaagcaguggaagcauuguucuugacgaccuuuccaucuuugguguggauuccggcuccgauucugc

SEQ ID NO: 1579 - RNA, 351 nt, artificial sequence
  synthetic construct
guaaugaucuucuucaagucgcguucaauggacuucuuaccuagaucaucaguccauuucuuagaugccuuagugaaggccuucuuuuugcucuuguaccaguucuuguagaagcgucugcgacagucuucagauaaaugcucagcccaaacuguggccaaagcccuaagaccauguggaguuucaauauaaccaacuacuccuacaacaaccauuggaggaguuuccaaaaugguaacagccucuacgauuucuuucuuauuuauuuuugaaccgggccugucugcuucucuuacaacgugggucauaccagcuuuauaaccgauaaaagcgguuaaauggacagguuuc

SEQ ID NO: 1580 - RNA, 350 nt, artificial sequence
  synthetic construct
gauguucccuggcccaugcaaccuuaucggcuacgguuccaccguuaaguugaauuuccaugaugugggcuuucuuuugacguuguuucaacaauuucaucugagugugagcaaccacccugacaaccuugcaguacuuaaugaucuucuucaagucgcguucaauggacuucuuaccuagaucaucaguccauuucuuagaugccuuagugaaggccuucuuuuugcucuuguaccaguucuuguagaagcgucugcgacagucuucagauaaaugcucagcccaaacuguggccaaagcccuaagaccauguggaguuucaauauaaccaacuacuccuacaacaacc

SEQ ID NO: 1581 - RNA, 351 nt, artificial sequence
  synthetic construct
guuuucaagauguucccuggcccaugcaaccuuaucggcuacgguuccaccguuaaguugaauuuccaugaugugggcuuucuuuugacguuguuucaacaauuucaucugagugugagcaaccacccugacaaccuugcaguacuuaaugaucuucuucaagucgcguucaauggacuucuuaccuagaucaucaguccauuucuuagaugccuuagugaaggccuucuuuuugcucuuguaccaguucuuguagaagcgucugcgacagucuucagauaaaugcucagcccaaacuguggccaaagcccuaagaccauguggaguuucaauauaaccaacuacuccuac

SEQ ID NO: 1582 - RNA, 351 nt, artificial sequence
  synthetic construct
gaucugagugugagcaaccacccugacaaccuugcaguacuuaaugaucuucuucaagucgcguucaauggacuucuuaccuagaucaucaguccauuucuuagaugccuuagugaaggccuucuuuuugcucuuguaccaguucuuguagaagcgucugcgacagucuucagauaaaugcucagcccaaacuguggccaaagcccuaagaccauguggaguuucaauauaaccaacuacuccuacaacaaccauuggaggaguuuccaaaaugguaacagccucuacgauuucuuucuuauuuauuuuugaaccgggccugucugcuucucuuacaacgugggucauacc

SEQ ID NO: 1583 - RNA, 352 nt, artificial sequence
  synthetic construct
guucuuguucaucucaguucugugaugguaaccuuucugaccagcacgggcuacggugaacgauacacgagaaggaugccacgcuccaauacaagcaacuuuacgaagacccuugugcguuuugcggggcaacuucuuugugugccaacgagaaguaacaccuuuguauccaugacccuuggugacaccaaugcagucaaucaucucaucuugggcaaagacguuggcaacagggauugguuuuucaagauguucccuggcccaugcaaccuuaucggcuacgguuccaccguuaaguugaauuuccaugaugugggcuuucuuuugacguuguuucaacaauuucaucugc

SEQ ID NO: 1584 - RNA, 351 nt, artificial sequence
  synthetic construct
guuucaacaacuauagcaccuucuaguuugcuuuguagcuucuuuuuaucaggaucgucaucuucaucacuaucacucuuuuugucuucuuuggaggagccuccaucuaauacuggcuucuuuuuaguuuuccuuauagauucuuuaauuuuuucagcccuuucuagauauuguacacacuuagcccuaauacuuuccuuagccuuuucucccugagcuucauacuuuauggcaugaagaaaauauucuacaccauguucauacaaacgaagagcuucuucauaauuuuuauuccuauccucuucgguggcuuuaguuacuaguucuauagcuuuuuguaaaguaguuccc

SEQ ID NO: 1585 - RNA, 350 nt, artificial sequence
  synthetic construct
gcaccuucuaguuugcuuuguagcuucuuuuuaucaggaucgucaucuucaucacuaucacucuuuuugucuucuuuggaggagccuccaucuaauacuggcuucuuuuuaguuuuccuuauagauucuuuaauuuuuucagcccuuucuagauauuguacacacuuagcccuaauacuuuccuuagccuuuucucccugagcuucauacuuuauggcaugaagaaaauauucuacaccauguucauacaaacgaagagcuucuucauaauuuuuauuccuauccucuucgguggcuuuaguuacuaguucuauagcuuuuuguaaaguaguucccguagccauuugaac

SEQ ID NO: 1586 - RNA, 351 nt, artificial sequence
  synthetic construct
guuuucaacaacuauagcaccuucuaguuugcuuuguagcuucuuuuuaucaggaucgucaucuucaucacuaucacucuuuuugucuucuuuggaggagccuccaucuaauacuggcuucuuuuuaguuuuccuuauagauucuuuaauuuuuucagcccuuucuagauauuguacacacuuagcccuaauacuuuccuuagccuuuucucccugagcuucauacuuuauggcaugaagaaaauauucuacaccauguucauacaaacgaagagcuucuucauaauuuuuauuccuauccucuucgguggcuuuaguuacuaguucuauagcuuuuuguaaaguaguucc

SEQ ID NO: 1587 - RNA, 351 nt, artificial sequence
  synthetic construct
guucuucugucaacucuguguggguauuuccuaaauguaauuugaacaugacagcucucgccgguucuuccgguagcgguauguaaauccuuuuuucgaaacgucuccugauggcggaaucuaauacccaaggaauauuaguagcuccuaacacuaagauacccucgguaucauggccaacaccuugcauuugaacuaaaaauuccgucuugauucuccuggcugauucagauucauuaucagaacgugacgaacaaagugaaucgauuucgucaaugaauaugaugcuggguuugugaguucuggccaacucgaacaaguucuugaccaauuucucagauucacccaacc

SEQ ID NO: 1588 - RNA, 352 nt, artificial sequence
  synthetic construct
guucuuguccgaaaucuuccauaaacuuccucaauuucguaagauccucaucauugacggugggcuucgaggugccaacugaucucaacaugucauucaaaguaaccgguggcucugcuaauuuuucgcucggaauauccauccaggacauuucuauugcaccagaaucaccgggcgagcaagguaugaguaaaucauccacuaugguauugggaucgacuggugaugguccccuaauccucuuaaagugggucgcgguuugaacuuuacgcacuggcugcaucagagcgucacguaccacgauacuaauaucagcaccagaguaaccuucaguuuuggaagccaacucuuc

SEQ ID NO: 1589 - RNA, 351 nt, artificial sequence
  synthetic construct
guuaauguccuuuagaggacguugaauaccaucaaaaauggaacccauaauaccagguccaaguucuacugauagagguuugccgguucucaauacagggucgccgacuguuacaccagaaguuucuucauauaccuggauaguugccauaucacccuccaaucgaauaauuucuccuacaagcucauaguacccuacacguacuaauucguacauagcagauccagacauuuuuucagcagugacgacuggaccggacacggcauggacauauccauacuggcccucuuuuucuucgucuccaacccggacucuagacauuuuuguggauguuauguaucuauugcaacc

SEQ ID NO: 1590 - RNA, 352 nt, artificial sequence
  synthetic construct
guuggauaucuucauacagcuggucaaaaucggcuuugauuuucgcuucgccgucuuuaacgggaucuuuaaacuucauacugcucaauugguacaaaauguugcucaucgaaucccugaucacguuccacgugaucuuguucucggacugagccgucgauucuacggcgugucuagccaugucguacaugccgaucauguucuugagcauuccgacgguuuuguagaacgggcaaaaacgaucguaggacgaguaggaguuuuguuggaggaaaucuucuuucaacagcuuggcgauuuccaaagugauuuugucagcuucggccaacgaugcuuuuccuacuaguugcac

SEQ ID NO: 1591 - RNA, 352 nt, artificial sequence
  synthetic construct
guuuccaauacaacuucaucaacuguguaauuuccugggucugcaacauauguuacaguucccuuagcuuuagguggaagagucauuuuaagcuucacaagaguguuuucaugaaccauaccauagaugucaccgccggucaaaugagaucccaacuugauguugaugggugcgaauucccacuuugccguucuggaaagugcuggaacauuuacaccuuucggaauguaaauacuuugaguuaagucguuaauguccuuuagaggacguugaauaccaucaaaaauggaacccauaauaccagguccaaguucuacugauagagguuugccgguucucaauacagggucgc

SEQ ID NO: 1592 - RNA, 352 nt, artificial sequence
  synthetic construct
guuucacuaacaggucuggcuugacguaccggccacacuugcaacaugguguauuuugugcguucuccaucaaauucaguuuccaauacaacuucaucaacuguguaauuuccugggucugcaacauauguuacaguucccuuagcuuuagguggaagagucauuuuaagcuucacaagaguguuuucaugaaccauaccauagaugucaccgccggucaaaugagaucccaacuugauguugaugggugcgaauucccacuuugccguucuggaaagugcuggaacauuuacaccuuucggaauguaaauacuuugaguuaagucguuaauguccuuuagaggacguugac

SEQ ID NO: 1593 - RNA, 352 nt, artificial sequence
  synthetic construct
guacaacuucaucaacuguguaauuuccugggucugcaacauauguuacaguucccuuagcuuuagguggaagagucauuuuaagcuucacaagaguguuuucaugaaccauaccauagaugucaccgccggucaaaugagaucccaacuugauguugaugggugcgaauucccacuuugccguucuggaaagugcuggaacauuuacaccuuucggaauguaaauacuuugaguuaagucguuaauguccuuuagaggacguugaauaccaucaaaaauggaacccauaauaccagguccaaguucuacugauagagguuugccgguucucaauacagggucgccgacugc

SEQ ID NO: 1594 - RNA, 351 nt, artificial sequence
  synthetic construct
gaaauguugcucaucgaaucccugaucacguuccacgugaucuuguucucggacugagccgucgauucuacggcgugucuagccaugucguacaugccgaucauguucuugagcauuccgacgguuuuguagaacgggcaaaaacgaucguaggacgaguaggaguuuuguuggaggaaaucuucuuucaacagcuuggcgauuuccaaagugauuuugucagcuucggccaacgaugcuuuuccuacuaguugcacgauuucugugagaucgucuucuuccugaagaauuuccuuaacuuuaguucuaagggguaugaauucggcaaaguuuuugucauagaaaucgucc

SEQ ID NO: 1595 - RNA, 352 nt, artificial sequence
  synthetic construct
guuucuaccgucaauucagggaagucccgcaauacuucagacauuucauuaccucuuucuccacaaccuacguagacaaugacaucagaauuggaguauuuggagagcgacugugaaauuacaguuuuuccacaaccaaaggcaccgggaauagcaguaguaccgcccugaacacaagggaagagggcauccaauacacguuguccgguaaguaggggaugauuggccggcaauuuuucacuaacaggucuggcuugacguaccggccacacuugcaacaugguguauuuugugcguucuccaucaaauucaguuuccaauacaacuucaucaacuguguaauuuccugggc

SEQ ID NO: 1596 - RNA, 352 nt, artificial sequence
  synthetic construct
guuucauuaccucuuucuccacaaccuacguagacaaugacaucagaauuggaguauuuggagagcgacugugaaauuacaguuuuuccacaaccaaaggcaccgggaauagcaguaguaccgcccugaacacaagggaagagggcauccaauacacguuguccgguaaguaggggaugauuggccggcaauuuuucacuaacaggucuggcuugacguaccggccacacuugcaacaugguguauuuugugcguucuccaucaaauucaguuuccaauacaacuucaucaacuguguaauuuccugggucugcaacauauguuacaguucccuuagcuuuagguggaagac

SEQ ID NO: 1597 - RNA, 352 nt, artificial sequence
  synthetic construct
gucuuuaaacuucauacugcucaauugguacaaaauguugcucaucgaaucccugaucacguuccacgugaucuuguucucggacugagccgucgauucuacggcgugucuagccaugucguacaugccgaucauguucuugagcauuccgacgguuuuguagaacgggcaaaaacgaucguaggacgaguaggaguuuuguuggaggaaaucuucuuucaacagcuuggcgauuuccaaagugauuuugucagcuucggccaacgaugcuuuuccuacuaguugcacgauuucugugagaucgucuucuuccugaagaauuuccuuaacuuuaguucuaagggguaugaac

SEQ ID NO: 1598 - RNA, 351 nt, artificial sequence
  synthetic construct
gacgugaucuuguucucggacugagccgucgauucuacggcgugucuagccaugucguacaugccgaucauguucuugagcauuccgacgguuuuguagaacgggcaaaaacgaucguaggacgaguaggaguuuuguuggaggaaaucuucuuucaacagcuuggcgauuuccaaagugauuuugucagcuucggccaacgaugcuuuuccuacuaguugcacgauuucugugagaucgucuucuuccugaagaauuuccuuaacuuuaguucuaagggguaugaauucggcaaaguuuuugucauagaaaucguccaaugcccucaaauauuuggaauaugaacugagc

SEQ ID NO: 1599 - RNA, 351 nt, artificial sequence
  synthetic construct
gucauuuuaagcuucacaagaguguuuucaugaaccauaccauagaugucaccgccggucaaaugagaucccaacuugauguugaugggugcgaauucccacuuugccguucuggaaagugcuggaacauuuacaccuuucggaauguaaauacuuugaguuaagucguuaauguccuuuagaggacguugaauaccaucaaaaauggaacccauaauaccagguccaaguucuacugauagagguuugccgguucucaauacagggucgccgacuguuacaccagaaguuucuucauauaccuggauaguugccauaucacccuccaaucgaauaauuucuccuacaagc

SEQ ID NO: 1600 - RNA, 352 nt, artificial sequence
  synthetic construct
guuucaauaauucucaaugcaguaacuauuacuguaggaucuuuucuuacaguauuuaauguucuauauaaaauaauaguuaacuguuuuucuaguaagcuggauaguacuucuacaucagcaaaauaugcuuuuaacauugauuuaucauguacagauugguuagguaauuugugaagcucaaauaguaagucaucucuugaauuuuccaagucucucaagcacugauguguaugaaguaacuuuccuucauuaauccaggauuuugucuuuucuacacuuucugggacuguaaaaauauguuucagauuuucuuuggcuguuacauauugcgaaugccucauauuuucac

SEQ ID NO: 1601 - RNA, 351 nt, artificial sequence
  synthetic construct
gcacuauaguucgcuucaauauucuuaagauagucuucuucuaaucugucuauaacagcagauggaaguaaaggagguaaauuuucaguagaggucacuaaaucagggugaccuaacaugucuuuggcucgauaaguuuuaagaacccaagacagcauuguaacauauucauuaccuugaaggccauuuuguauaauuuccugcagauguacggaaaggcauccaugguagauaugaauauauuuaucuaauauuuuauaacuuggaggaaagcacgguaagcaaagaguuuugacaauucuuaaaucuucuaaaaucaucauucuaauaaguucuaaauaucuuaucagc

SEQ ID NO: 1602 - RNA, 352 nt, artificial sequence
  synthetic construct
guacaaaaaguucuucuagcaaguacaugacugcgucauuccucaauuuaauauaaguacuuuuuaacaugccaaaauucuugguaaguucaugugaacuguuauuaguaacauacuguuuuucuaauugacaccccaacuccacaaguuguaaaguauuauuuacuauuaaaaucauauacugggugaaauaaacgacuuguuuccuguccucaaaauauuuguucuuaaauucaauaauagcaucccugaaagcaucugcgaauauuauaacuugucuaaugcuuaaauucaagcauuuaaauguuagcucuucacuuauuguuuugguuacuuguaaauucugaucuac

SEQ ID NO: 1603 - RNA, 352 nt, artificial sequence
  synthetic construct
guauuaaaaucauauacugggugaaauaaacgacuuguuuccuguccucaaaauauuuguucuuaaauucaauaauagcaucccugaaagcaucugcgaauauuauaacuugucuaaugcuuaaauucaagcauuuaaauguuagcucuucacuuauuguuuugguuacuuguaaauucugaucuaucauuugaaaaauaauaauuggggcuggcguacgagaauaugacucugaauaagguucaguauucauccuccauuccucuuuuucugauuuaagaguauuuugcauccauucacuauaguucgcuucaauauucuuaagauagucuucuucuaaucugucuauaac

SEQ ID NO: 1604 - RNA, 351 nt, artificial sequence
  synthetic construct
guuuucuacacuuucugggacuguaaaaauauguuucagauuuucuuuggcuguuacauauugcgaaugccucauauuuucaucucuaauaucacagaguaccuuacuaagcucugguacaucagaaaauaagucugacaucuuuuucauacuaauauuaauuucagauacuucuucgagacaccuguguaguugauucaaaccaauucuaacaccaucuagcuguugcugcauugcugacuucagcaaugcuucaacugaagcuuuuuuucgaacauaucguuguuuuauuuggucaauuuuuucuaauuguccuggccuauucaauguauuuaucacuuuaguaguagc

SEQ ID NO: 1605 - RNA, 351 nt, artificial sequence
  synthetic construct
guuucugauuuaagaguauuuugcauccauucacuauaguucgcuucaauauucuuaagauagucuucuucuaaucugucuauaacagcagauggaaguaaaggagguaaauuuucaguagaggucacuaaaucagggugaccuaacaugucuuuggcucgauaaguuuuaagaacccaagacagcauuguaacauauucauuaccuugaaggccauuuuguauaauuuccugcagauguacggaaaggcauccaugguagauaugaauauauuuaucuaauauuuuauaacuuggaggaaagcacgguaagcaaagaguuuugacaauucuuaaaucuucuaaaaucauc

SEQ ID NO: 1606 - RNA, 351 nt, artificial sequence
  synthetic construct
guagaaaguuaaauuaauauuuacaagcuuaggaaacaccagggucuuaaacacugugcucuuaugcagaacuuuaggcuuaucuacaugcacaacuuuaucucugacaucugaucuugacaggucuccucucagguucagcagucuuaaaagaugaucaucaguaauaucaggauacuuuucaaccacccuauguagcucaaaggauaacaugucaucaucgcuuuucagcacuucagagagcauaaugauggcaucaaauggguucucgcauucuauaucauuacugagauuuucaaagaguuuguugaaucuauuggcuucuuccgaaacuuuuugggcagcuuucac

SEQ ID NO: 1607 - RNA, 352 nt, artificial sequence
  synthetic construct
gucuuaaauucaauaauagcaucccugaaagcaucugcgaauauuauaacuugucuaaugcuuaaauucaagcauuuaaauguuagcucuucacuuauuguuuugguuacuuguaaauucugaucuaucauuugaaaaauaauaauuggggcuggcguacgagaauaugacucugaauaagguucaguauucauccuccauuccucuuuuucugauuuaagaguauuuugcauccauucacuauaguucgcuucaauauucuuaagauagucuucuucuaaucugucuauaacagcagauggaaguaaaggagguaaauuuucaguagaggucacuaaaucagggugaccuc

SEQ ID NO: 1608 - RNA, 352 nt, artificial sequence
  synthetic construct
guuuaggcuuaucuacaugcacaacuuuaucucugacaucugaucuugacaggucuccucucagguucagcagucuuaaaagaugaucaucaguaauaucaggauacuuuucaaccacccuauguagcucaaaggauaacaugucaucaucgcuuuucagcacuucagagagcauaaugauggcaucaaauggguucucgcauucuauaucauuacugagauuuucaaagaguuuguugaaucuauuggcuucuuccgaaacuuuuugggcagcuuucaugcauucaucgaaaguuuugaaagauaugcgccuagacagcauagcuguaagauauuuucuacccacuagggc

SEQ ID NO: 1609 - RNA, 351 nt, artificial sequence
  synthetic construct
gacaacuuuaucucugacaucugaucuugacaggucuccucucagguucagcagucuuaaaagaugaucaucaguaauaucaggauacuuuucaaccacccuauguagcucaaaggauaacaugucaucaucgcuuuucagcacuucagagagcauaaugauggcaucaaauggguucucgcauucuauaucauuacugagauuuucaaagaguuuguugaaucuauuggcuucuuccgaaacuuuuugggcagcuuucaugcauucaucgaaaguuuugaaagauaugcgccuagacagcauagcuguaagauauuuucuacccacuaggguuaauaauaauuccacugc

SEQ ID NO: 1610 - RNA, 352 nt, artificial sequence
  synthetic construct
guaaauuaauauuuacaagcuuaggaaacaccagggucuuaaacacugugcucuuaugcagaacuuuaggcuuaucuacaugcacaacuuuaucucugacaucugaucuugacaggucuccucucagguucagcagucuuaaaagaugaucaucaguaauaucaggauacuuuucaaccacccuauguagcucaaaggauaacaugucaucaucgcuuuucagcacuucagagagcauaaugauggcaucaaauggguucucgcauucuauaucauuacugagauuuucaaagaguuuguugaaucuauuggcuucuuccgaaacuuuuugggcagcuuucaugcauucauc

SEQ ID NO: 1611 - RNA, 351 nt, artificial sequence
  synthetic construct
gcuagccguuucaggaaagacacauuuacuuacuaacuugucagcuugaucauauaaugaauaaugcaaauaguuucucaauaagcaauuuauaaguacagcuuguccuucaaaaucauuucuaagaguagcaguacgaagacgagaauguagaaaaccucuaauugaaucaaguuuaucaguaaguucagaaacccuugagugauaaaaguagcacuuagcugcuacaagaucuauggaacggcgauuuugacuaguaauuuuauucaugagugcuugagaacaacguucugcuucugguaguuuauuagugucaaucaaacgaaccaaaauuaacaaguuaauauaagc

SEQ ID NO: 1612 - RNA, 351 nt, artificial sequence
  synthetic construct
gucaacuucuggaacaggaguuuuugaagcugaucuagcucuagauugcguagugucaaguucaguugcagccucuucaguaaaaccaaguaggacgucucucucggcuacaggauauauuugguuuauaagacuucugagaacuacuccauuaagcuuucgucuaguguugggcaaacaacgcaaaacucuuaaaauaaaucgauuuuccuugcugcuuacggcuuuuucaaucugucuugcauguucucgaauuucuauuacacuuugcaugucagugucuuuuuugcuaucuccagcuuccaauccuccaggacugucggcguuuuucauuucaacaucuguuucaac

SEQ ID NO: 1613 - RNA, 351 nt, artificial sequence
  synthetic construct
guaucucauagcuuucacacuuugauuaugcaaaucuaagcaaaaugauauucucugaugaaaagcaaguugugguuccuuuguacaguaaauaucuguacucucuuuacuucucaugaaaccaccuugaggaucuagaguagccucaauuaccccaucacgaauggcuuuugccacaauaaauucugcaucuucagcugaaucaagaccaaguuuuuuagcuauaucuugaggagaaauucuagaauaagacagaccaauagaucuuauagccgucuuuaugacauugugacggagacguagaauuaaaguaaaaguauggucuugucuaaauugugguccaaaguuuuc

SEQ ID NO: 1614 - RNA, 352 nt, artificial sequence
  synthetic construct
guaaauucugcaucuucagcugaaucaagaccaaguuuuuuagcuauaucuugaggagaaauucuagaauaagacagaccaauagaucuuauagccgucuuuaugacauugugacggagacguagaauuaaaguaaaaguauggucuugucuaaauugugguccaaaguuuuccaaaacuucuccaaaucucugcaaauuucccauucuuaccgccugagucaacugaaaguaaggugcaagggaaugccucaugcuggcuugccuaaauauuugucucucugguauaucucccaauaguaauucaacuacaacaguuaguuucugaacaguuugucuaaaaccuauugcac

SEQ ID NO: 1615 - RNA, 352 nt, artificial sequence
  synthetic construct
guuugucuaaaaccuauugcagcauucugaggugcuuuucucauggcuugaacaaggugcuuaugggcuacacuguauucuaaucuagcagcuuuaauucgacccaaauaauacaaaaaucuggcccauucauuauuacuagccguuucaggaaagacacauuuacuuacuaacuugucagcuugaucauauaaugaauaaugcaaauaguuucucaauaagcaauuuauaaguacagcuuguccuucaaaaucauuucuaagaguagcaguacgaagacgagaauguagaaaaccucuaauugaaucaaguuuaucaguaaguucagaaacccuugagugauaaaaguagc

SEQ ID NO: 1616 - RNA, 352 nt, artificial sequence
  synthetic construct
guucagcagauucuaacuccuuuccauaggcuuuuggaggauaucucauagcuuucacacuuugauuaugcaaaucuaagcaaaaugauauucucugaugaaaagcaaguugugguuccuuuguacaguaaauaucuguacucucuuuacuucucaugaaaccaccuugaggaucuagaguagccucaauuaccccaucacgaauggcuuuugccacaauaaauucugcaucuucagcugaaucaagaccaaguuuuuuagcuauaucuugaggagaaauucuagaauaagacagaccaauagaucuuauagccgucuuuaugacauugugacggagacguagaauuaaagc

SEQ ID NO: 1617 - RNA, 352 nt, artificial sequence
  synthetic construct
gaucaucaucuucuucugccauuucuuuugcuaauucuaaaucuuguuguucccuuucccuucuuucuucagcagauucuaacuccuuuccauaggcuuuuggaggauaucucauagcuuucacacuuugauuaugcaaaucuaagcaaaaugauauucucugaugaaaagcaaguugugguuccuuuguacaguaaauaucuguacucucuuuacuucucaugaaaccaccuugaggaucuagaguagccucaauuaccccaucacgaauggcuuuugccacaauaaauucugcaucuucagcugaaucaagaccaaguuuuuuagcuauaucuugaggagaaauucuagc

SEQ ID NO: 1618 - RNA, 351 nt, artificial sequence
  synthetic construct
guuucacacuuugauuaugcaaaucuaagcaaaaugauauucucugaugaaaagcaaguugugguuccuuuguacaguaaauaucuguacucucuuuacuucucaugaaaccaccuugaggaucuagaguagccucaauuaccccaucacgaauggcuuuugccacaauaaauucugcaucuucagcugaaucaagaccaaguuuuuuagcuauaucuugaggagaaauucuagaauaagacagaccaauagaucuuauagccgucuuuaugacauugugacggagacguagaauuaaaguaaaaguauggucuugucuaaauugugguccaaaguuuuccaaaacuucuc

SEQ ID NO: 1619 - RNA, 352 nt, artificial sequence
  synthetic construct
guacuuacuaacuugucagcuugaucauauaaugaauaaugcaaauaguuucucaauaagcaauuuauaaguacagcuuguccuucaaaaucauuucuaagaguagcaguacgaagacgagaauguagaaaaccucuaauugaaucaaguuuaucaguaaguucagaaacccuugagugauaaaaguagcacuuagcugcuacaagaucuauggaacggcgauuuugacuaguaauuuuauucaugagugcuugagaacaacguucugcuucugguaguuuauuagugucaaucaaacgaaccaaaauuaacaaguuaauauaagcaucaacuucuggaacaggaguuuuuc

SEQ ID NO: 1620 - RNA, 351 nt, artificial sequence
  synthetic construct
gauacaaaaaucuggcccauucauuauuacuagccguuucaggaaagacacauuuacuuacuaacuugucagcuugaucauauaaugaauaaugcaaauaguuucucaauaagcaauuuauaaguacagcuuguccuucaaaaucauuucuaagaguagcaguacgaagacgagaauguagaaaaccucuaauugaaucaaguuuaucaguaaguucagaaacccuugagugauaaaaguagcacuuagcugcuacaagaucuauggaacggcgauuuugacuaguaauuuuauucaugagugcuugagaacaacguucugcuucugguaguuuauuagugucaaucaaac

SEQ ID NO: 1621 - RNA, 352 nt, artificial sequence
  synthetic construct
guucuaaaucuuguuguucccuuucccuucuuucuucagcagauucuaacuccuuuccauaggcuuuuggaggauaucucauagcuuucacacuuugauuaugcaaaucuaagcaaaaugauauucucugaugaaaagcaaguugugguuccuuuguacaguaaauaucuguacucucuuuacuucucaugaaaccaccuugaggaucuagaguagccucaauuaccccaucacgaauggcuuuugccacaauaaauucugcaucuucagcugaaucaagaccaaguuuuuuagcuauaucuugaggagaaauucuagaauaagacagaccaauagaucuuauagccgucuc

SEQ ID NO: 1622 - RNA, 352 nt, artificial sequence
  synthetic construct
guaucuaaguaaucuucugccaaaauugggggaccuuuaucaauugguuuuccagauccguugaacacucuacccaacauauccucagauacuggaguucugagaauaucaccagugaauucacauacuguguuuuuggcaucaauuccugaggugccuucaaauacuuguacuacagcuuuauucccacugacuuccaaaacuugaccagaucuuaaaguuccaucagccaaucuaaguuggacaauuucguugaauuuugggaacuuuacaucuuccagaauuaccaguggaccauugacaccagauaccguuuuauaagugagucugggcugagauacaaaaucucugc

SEQ ID NO: 1623 - RNA, 351 nt, artificial sequence
  synthetic construct
gauaucaccagugaauucacauacuguguuuuuggcaucaauuccugaggugccuucaaauacuuguacuacagcuuuauucccacugacuuccaaaacuugaccagaucuuaaaguuccaucagccaaucuaaguuggacaauuucguugaauuuugggaacuuuacaucuuccagaauuaccaguggaccauugacaccagauaccguuuuauaagugagucugggcugagauacaaaaucucuggaaacagccaaaauauguucccgugaggccuguuuugcauuuaacgucgaaggguaagacaucuucucugaaggaaagauacgucugucacaaaccacaaaaac

SEQ ID NO: 1624 - RNA, 352 nt, artificial sequence
  synthetic construct
guuucuucaggauaaauacgugaccauggguugauagguugaccuuggauaucuaaguaaucuucugccaaaauugggggaccuuuaucaauugguuuuccagauccguugaacacucuacccaacauauccucagauacuggaguucugagaauaucaccagugaauucacauacuguguuuuuggcaucaauuccugaggugccuucaaauacuuguacuacagcuuuauucccacugacuuccaaaacuugaccagaucuuaaaguuccaucagccaaucuaaguuggacaauuucguugaauuuugggaacuuuacaucuuccagaauuaccaguggaccauugacac

SEQ ID NO: 1625 - RNA, 352 nt, artificial sequence
  synthetic construct
guagcagcaaacacaauagcaaaguuaucuucauggucauccaauacagauuugccgggaauuuugacaagaccggcuugucgacaaauuugagcagcaauuucguugugaggcagaccagcggccgagaaaaugggaauuuuuuggccacgggcaauggaguucauuacgucgauggcggagauaccaguuuggaucauuucuucaggauaaauacgugaccauggguugauagguugaccuuggauaucuaaguaaucuucugccaaaauugggggaccuuuaucaauugguuuuccagauccguugaacacucuacccaacauauccucagauacuggaguucugagac

SEQ ID NO: 1626 - RNA, 351 nt, artificial sequence
  synthetic construct
guaaugacgcgagucucugggauagaauucggccaauauacuggcugggauacguuucaacauuuccuuggggaagauacggaguaguugccaaccgauguccaaugauucgaaaacgguacgguuuucguaguuacccugagugaugaaguucuuuucgaauuucguuaagaauuccaaguacaggagaucgucagguguaagagcuuccucuccuacuacggcuuucauagcuuggacauccuuaccgauagcguaacaggcauacaguugguuagaaacgucagagugaucuuuccuggucauacccucaccaauggcggauuucaucaaacgagacaaagagggcac

SEQ ID NO: 1627 - RNA, 352 nt, artificial sequence
  synthetic construct
gaucuaaguaaucuucugccaaaauugggggaccuuuaucaauugguuuuccagauccguugaacacucuacccaacauauccucagauacuggaguucugagaauaucaccagugaauucacauacuguguuuuuggcaucaauuccugaggugccuucaaauacuuguacuacagcuuuauucccacugacuuccaaaacuugaccagaucuuaaaguuccaucagccaaucuaaguuggacaauuucguugaauuuugggaacuuuacaucuuccagaauuaccaguggaccauugacaccagauaccguuuuauaagugagucugggcugagauacaaaaucucuggc

SEQ ID NO: 1628 - RNA, 352 nt, artificial sequence
  synthetic construct
gaaacagacauacauuuuccauggaaccauuuucuucgaaaucuuguuugaaaaaccuagcaguuuccauguuaacucccauagcagcaaacacaauagcaaaguuaucuucauggucauccaauacagauuugccgggaauuuugacaagaccggcuugucgacaaauuugagcagcaauuucguugugaggcagaccagcggccgagaaaaugggaauuuuuuggccacgggcaauggaguucauuacgucgauggcggagauaccaguuuggaucauuucuucaggauaaauacgugaccauggguugauagguugaccuuggauaucuaaguaaucuucugccaaaac

SEQ ID NO: 1629 - RNA, 352 nt, artificial sequence
  synthetic construct
gugccaaccgauguccaaugauucgaaaacgguacgguuuucguaguuacccugagugaugaaguucuuuucgaauuucguuaagaauuccaaguacaggagaucgucagguguaagagcuuccucuccuacuacggcuuucauagcuuggacauccuuaccgauagcguaacaggcauacaguugguuagaaacgucagagugaucuuuccuggucauacccucaccaauggcggauuucaucaaacgagacaaagagggcaauacauugacuggaggauagauuugccuauugugcaauugacggucuacguagaucugucccucgguaauauaaccugucaaaucgggc

SEQ ID NO: 1630 - RNA, 352 nt, artificial sequence
  synthetic construct
gcaacauauccucagauacuggaguucugagaauaucaccagugaauucacauacuguguuuuuggcaucaauuccugaggugccuucaaauacuuguacuacagcuuuauucccacugacuuccaaaacuugaccagaucuuaaaguuccaucagccaaucuaaguuggacaauuucguugaauuuugggaacuuuacaucuuccagaauuaccaguggaccauugacaccagauaccguuuuauaagugagucugggcugagauacaaaaucucuggaaacagccaaaauauguucccgugaggccuguuuugcauuuaacgucgaaggguaagacaucuucucugaagc

SEQ ID NO: 1631 - RNA, 351 nt, artificial sequence
  synthetic construct
gaaauaggcuccagaaggaucacacuggaauaaauaaggccuauuauugucccauccacagaucaauaaagaaacaccaaaaggucugacaccuccagauuggguauacucuugcauuacugcugcuacucucugaaccaauugcacuguaggaauagguuccugauacacaagguaauauuguugggccauuuuacgcgcuuguuuuacuagcaaacgguaaucuggucccaugccagaauaaaccauuccaauguguuugguaaucauuucaacuuugugaacgcuguguucaucauaaagaauugauuuauguuuguuuucuguagcuauuacaacuccauuacaugc

SEQ ID NO: 1632 - RNA, 351 nt, artificial sequence
  synthetic construct
guuugccaaaaaguccuucacuguagaaggaucgaaccuucugaaaccugauucaucgcaaauuccaacuucaauguuaucagcugucaucuggcccucgaaacuuucuuuuaauguuaaaauugcaguguguacagcaucgucuaauuccaauucuucacuguaccuuuuuuccaagaaaguuuucccauuaacauaauuuuugcccauagcaguagcuuuccaagcaaaauaggcuccagaaggaucacacuggaauaaauaaggccuauuauugucccauccacagaucaauaaagaaacaccaaaaggucugacaccuccagauuggguauacucuugcauuacugc

SEQ ID NO: 1633 - RNA, 352 nt, artificial sequence
  synthetic construct
guccuucacuguagaaggaucgaaccuucugaaaccugauucaucgcaaauuccaacuucaauguuaucagcugucaucuggcccucgaaacuuucuuuuaauguuaaaauugcaguguguacagcaucgucuaauuccaauucuucacuguaccuuuuuuccaagaaaguuuucccauuaacauaauuuuugcccauagcaguagcuuuccaagcaaaauaggcuccagaaggaucacacuggaauaaauaaggccuauuauugucccauccacagaucaauaaagaaacaccaaaaggucugacaccuccagauuggguauacucuugcauuacugcugcuacucucugc

SEQ ID NO: 1634 - RNA, 352 nt, artificial sequence
  synthetic construct
gcucugaaccaauugcacuguaggaauagguuccugauacacaagguaauauuguugggccauuuuacgcgcuuguuuuacuagcaaacgguaaucuggucccaugccagaauaaaccauuccaauguguuugguaaucauuucaacuuugugaacgcuguguucaucauaaagaauugauuuauguuuguuuucuguagcuauuacaacuccauuacaugcuuuaauuccuacugauggugcgccugccgcuacagccgcuaaggcauauucaauuugaacuaauuuaccggaagggcuaaaaguaguuaaagaaaaacuauaacguucggaugccauuauuucuaaugac

SEQ ID NO: 1635 - RNA, 350 nt, artificial sequence
  synthetic construct
gcuuuccaagcaaaauaggcuccagaaggaucacacuggaauaaauaaggccuauuauugucccauccacagaucaauaaagaaacaccaaaaggucugacaccuccagauuggguauacucuugcauuacugcugcuacucucugaaccaauugcacuguaggaauagguuccugauacacaagguaauauuguugggccauuuuacgcgcuuguuuuacuagcaaacgguaaucuggucccaugccagaauaaaccauuccaauguguuugguaaucauuucaacuuugugaacgcuguguucaucauaaagaauugauuuauguuuguuuucuguagcuauuacaac

SEQ ID NO: 1636 - RNA, 351 nt, artificial sequence
  synthetic construct
gcacuggaauaaauaaggccuauuauugucccauccacagaucaauaaagaaacaccaaaaggucugacaccuccagauuggguauacucuugcauuacugcugcuacucucugaaccaauugcacuguaggaauagguuccugauacacaagguaauauuguugggccauuuuacgcgcuuguuuuacuagcaaacgguaaucuggucccaugccagaauaaaccauuccaauguguuugguaaucauuucaacuuugugaacgcuguguucaucauaaagaauugauuuauguuuguuuucuguagcuauuacaacuccauuacaugcuuuaauuccuacugauggugc

SEQ ID NO: 1637 - RNA, 352 nt, artificial sequence
  synthetic construct
guucugaaaccugauucaucgcaaauuccaacuucaauguuaucagcugucaucuggcccucgaaacuuucuuuuaauguuaaaauugcaguguguacagcaucgucuaauuccaauucuucacuguaccuuuuuuccaagaaaguuuucccauuaacauaauuuuugcccauagcaguagcuuuccaagcaaaauaggcuccagaaggaucacacuggaauaaauaaggccuauuauugucccauccacagaucaauaaagaaacaccaaaaggucugacaccuccagauuggguauacucuugcauuacugcugcuacucucugaaccaauugcacuguaggaauagguc

SEQ ID NO: 1638 - RNA, 352 nt, artificial sequence
  synthetic construct
gcuuuccaagcaaaauaggcuccagaaggaucacacuggaauaaauaaggccuauuauugucccauccacagaucaauaaagaaacaccaaaaggucugacaccuccagauuggguauacucuugcauuacugcugcuacucucugaaccaauugcacuguaggaauagguuccugauacacaagguaauauuguugggccauuuuacgcgcuuguuuuacuagcaaacgguaaucuggucccaugccagaauaaaccauuccaauguguuugguaaucauuucaacuuugugaacgcuguguucaucauaaagaauugauuuauguuuguuuucuguagcuauuacaacuc

SEQ ID NO: 1639 - RNA, 351 nt, artificial sequence
  synthetic construct
gauagcaguagcuuuccaagcaaaauaggcuccagaaggaucacacuggaauaaauaaggccuauuauugucccauccacagaucaauaaagaaacaccaaaaggucugacaccuccagauuggguauacucuugcauuacugcugcuacucucugaaccaauugcacuguaggaauagguuccugauacacaagguaauauuguugggccauuuuacgcgcuuguuuuacuagcaaacgguaaucuggucccaugccagaauaaaccauuccaauguguuugguaaucauuucaacuuugugaacgcuguguucaucauaaagaauugauuuauguuuguuuucuguagc

SEQ ID NO: 1640 - RNA, 352 nt, artificial sequence
  synthetic construct
gccuucacuguagaaggaucgaaccuucugaaaccugauucaucgcaaauuccaacuucaauguuaucagcugucaucuggcccucgaaacuuucuuuuaauguuaaaauugcaguguguacagcaucgucuaauuccaauucuucacuguaccuuuuuuccaagaaaguuuucccauuaacauaauuuuugcccauagcaguagcuuuccaagcaaaauaggcuccagaaggaucacacuggaauaaauaaggccuauuauugucccauccacagaucaauaaagaaacaccaaaaggucugacaccuccagauuggguauacucuugcauuacugcugcuacucucugac

SEQ ID NO: 1641 - RNA, 351 nt, artificial sequence
  synthetic construct
guaucagcugucaucuggcccucgaaacuuucuuuuaauguuaaaauugcaguguguacagcaucgucuaauuccaauucuucacuguaccuuuuuuccaagaaaguuuucccauuaacauaauuuuugcccauagcaguagcuuuccaagcaaaauaggcuccagaaggaucacacuggaauaaauaaggccuauuauugucccauccacagaucaauaaagaaacaccaaaaggucugacaccuccagauuggguauacucuugcauuacugcugcuacucucugaaccaauugcacuguaggaauagguuccugauacacaagguaauauuguugggccauuuuacgc

SEQ ID NO: 1642 - RNA, 352 nt, artificial sequence
  synthetic construct
gucucuucacuaauaauagcugcuaguucguccucuacagcagccucaucuucaucagucaacuggccacuaagcaguucauugauuucauuuuguuugucuacucccucucuuguuucgucuaauauacguucaauaucuucaauauuuagagcagcauugacuuuuuucagagcuucauuuccuguuuuaagaccuucuacuaccuguacuucaacuugggcaaauucuauaucacuagccauacuuucuaaguugcuuaguugaccaucuaguuuggacagaaucuguucuugguaucguuucuuuuugaggagcaguuuugcucuuucuuuuuggccauuguuuaauc

SEQ ID NO: 1643 - RNA, 351 nt, artificial sequence
  synthetic construct
guuuuucagagcuucauuuccuguuuuaagaccuucuacuaccuguacuucaacuugggcaaauucuauaucacuagccauacuuucuaaguugcuuaguugaccaucuaguuuggacagaaucuguucuugguaucguuucuuuuugaggagcaguuuugcucuuucuuuuuggccauuguuuaauaguuucuuagcuaauuccuugucuuuaacaagagauaguucuauucuucuuugauacuguuuuaguuugucucuuugcuguuuuaguuguaauauugcuuugucuuguucaguaacucuacugggcuuuuucuuuuugccgaauauuauacccaugucgagauc

SEQ ID NO: 1644 - RNA, 352 nt, artificial sequence
  synthetic construct
guaucuucaauauuuagagcagcauugacuuuuuucagagcuucauuuccuguuuuaagaccuucuacuaccuguacuucaacuugggcaaauucuauaucacuagccauacuuucuaaguugcuuaguugaccaucuaguuuggacagaaucuguucuugguaucguuucuuuuugaggagcaguuuugcucuuucuuuuuggccauuguuuaauaguuucuuagcuaauuccuugucuuuaacaagagauaguucuauucuucuuugauacuguuuuaguuugucucuuugcuguuuuaguuguaauauugcuuugucuuguucaguaacucuacugggcuuuuucuuuc

SEQ ID NO: 1645 - RNA, 351 nt, artificial sequence
  synthetic construct
gcauugauuucauuuuguuugucuacucccucucuuguuucgucuaauauacguucaauaucuucaauauuuagagcagcauugacuuuuuucagagcuucauuuccuguuuuaagaccuucuacuaccuguacuucaacuugggcaaauucuauaucacuagccauacuuucuaaguugcuuaguugaccaucuaguuuggacagaaucuguucuugguaucguuucuuuuugaggagcaguuuugcucuuucuuuuuggccauuguuuaauaguuucuuagcuaauuccuugucuuuaacaagagauaguucuauucuucuuugauacuguuuuaguuugucucuuugc

SEQ ID NO: 1646 - RNA, 351 nt, artificial sequence
  synthetic construct
gucaacuggccacuaagcaguucauugauuucauuuuguuugucuacucccucucuuguuucgucuaauauacguucaauaucuucaauauuuagagcagcauugacuuuuuucagagcuucauuuccuguuuuaagaccuucuacuaccuguacuucaacuugggcaaauucuauaucacuagccauacuuucuaaguugcuuaguugaccaucuaguuuggacagaaucuguucuugguaucguuucuuuuugaggagcaguuuugcucuuucuuuuuggccauuguuuaauaguuucuuagcuaauuccuugucuuuaacaagagauaguucuauucuucuuugauac

SEQ ID NO: 1647 - RNA, 351 nt, artificial sequence
  synthetic construct
guaauauacguucaauaucuucaauauuuagagcagcauugacuuuuuucagagcuucauuuccuguuuuaagaccuucuacuaccuguacuucaacuugggcaaauucuauaucacuagccauacuuucuaaguugcuuaguugaccaucuaguuuggacagaaucuguucuugguaucguuucuuuuugaggagcaguuuugcucuuucuuuuuggccauuguuuaauaguuucuuagcuaauuccuugucuuuaacaagagauaguucuauucuucuuugauacuguuuuaguuugucucuuugcuguuuuaguuguaauauugcuuugucuuguucaguaacucuac

SEQ ID NO: 1648 - RNA, 350 nt, artificial sequence
  synthetic construct
gucuaauauacguucaauaucuucaauauuuagagcagcauugacuuuuuucagagcuucauuuccuguuuuaagaccuucuacuaccuguacuucaacuugggcaaauucuauaucacuagccauacuuucuaaguugcuuaguugaccaucuaguuuggacagaaucuguucuugguaucguuucuuuuugaggagcaguuuugcucuuucuuuuuggccauuguuuaauaguuucuuagcuaauuccuugucuuuaacaagagauaguucuauucuucuuugauacuguuuuaguuugucucuuugcuguuuuaguuguaauauugcuuugucuuguucaguaacuc

SEQ ID NO: 1649 - RNA, 352 nt, artificial sequence
  synthetic construct
guuguuucgucuaauauacguucaauaucuucaauauuuagagcagcauugacuuuuuucagagcuucauuuccuguuuuaagaccuucuacuaccuguacuucaacuugggcaaauucuauaucacuagccauacuuucuaaguugcuuaguugaccaucuaguuuggacagaaucuguucuugguaucguuucuuuuugaggagcaguuuugcucuuucuuuuuggccauuguuuaauaguuucuuagcuaauuccuugucuuuaacaagagauaguucuauucuucuuugauacuguuuuaguuugucucuuugcuguuuuaguuguaauauugcuuugucuuguucac

SEQ ID NO: 1650 - RNA, 351 nt, artificial sequence
  synthetic construct
guauuucuuagcggcugcugcuucaucuucccucugguaguucugcaacacuucuugcuucuuuguagcaauacguucuucccgucuuucucuagcuuguuucaccuucauucuccuggcauuagcuugaucugcuaacaucuuagcacgugccuucucagccuucuuuuugugaauguauuccauaagaacacguuuguucuugaauacauuacccuuagccuucauguacagugagugguauagaugucugucaaucuuuuucgcuucccgauauuuuuuuaauaaucgacgcaaaacgcgcaugcgcuggauccauaauuccuuuugggguguacgggcauuagcagc

SEQ ID NO: 1651 - RNA, 351 nt, artificial sequence
  synthetic construct
gauacauuacccuuagccuucauguacagugagugguauagaugucugucaaucuuuuucgcuucccgauauuuuuuuaauaaucgacgcaaaacgcgcaugcgcuggauccauaauuccuuuugggguguacgggcauuagcaguaccuuuccuuuuaccaaaaccgcagugccuccccuuucuacgagcuucgguguucuuacguacgcgggcacgugaauguaccgcuacagguuucuuaauaauaagaccauccuugaucaauuuacgaauauuuugucuggaauuuguauuggcaaucucauugauuucauuaggauccaaccauacuuucuucuuaccacaucuc

SEQ ID NO: 1652 - RNA, 351 nt, artificial sequence
  synthetic construct
gucaaucuuuuucgcuucccgauauuuuuuuaauaaucgacgcaaaacgcgcaugcgcuggauccauaauuccuuuugggguguacgggcauuagcaguaccuuuccuuuuaccaaaaccgcagugccuccccuuucuacgagcuucgguguucuuacguacgcgggcacgugaauguaccgcuacagguuucuuaauaauaagaccauccuugaucaauuuacgaauauuuugucuggaauuuguauuggcaaucucauugauuucauuaggauccaaccauacuuucuucuuaccacaucucauaacagaggcugccagccucuuuugaaguuuuaaggaacucauugc

SEQ ID NO: 1653 - RNA, 351 nt, artificial sequence
  synthetic construct
guuacccuuagccuucauguacagugagugguauagaugucugucaaucuuuuucgcuucccgauauuuuuuuaauaaucgacgcaaaacgcgcaugcgcuggauccauaauuccuuuugggguguacgggcauuagcaguaccuuuccuuuuaccaaaaccgcagugccuccccuuucuacgagcuucgguguucuuacguacgcgggcacgugaauguaccgcuacagguuucuuaauaauaagaccauccuugaucaauuuacgaauauuuugucuggaauuuguauuggcaaucucauugauuucauuaggauccaaccauacuuucuucuuaccacaucucauaac

SEQ ID NO: 1654 - RNA, 351 nt, artificial sequence
  synthetic construct
gacuaaugggucaaccuuauuggguaaaaucuuaugcaauguguaugauucauuucuaagggcuacucuacaauuuggugugacaucauuaaugucaauguuuuuaucgauaucaacaacaaauuuuccuucaggguguacuuugacaaguacuuuuuucuuguccauggguuuuacaacuucaccaacauagcuucccuguucuugaagaagcaucaguucuucucuaagcauacgaacuuuagcauuaaguucauuccuuugagcuuguaaccuacgaagauuuugacuuuuuucagcuacaauaagcuguaacucuucaauuuuggugauauaauaugaucuaaaucc

SEQ ID NO: 1655 - RNA, 352 nt, artificial sequence
  synthetic construct
guucaaaaucuucuugugucacaugaacccuucucucccucaaagcguacauacccgccucugugcaaacacccuuaacuucagccccgcuagcaccuggcauuaauucagcgauuuuccuuaaauugauaccucuaguuagauucauuuuucucgaaugaauuuucaaaauguccaaucuggcuucuucguucgguggagggaacucaauuuuucugucaauucuuccaggucuaagcaaagcaggaucaagaaugucuauucuguugguagccaugaugacuuuaauguuuuugguugcuucaaaaccaucaagcugauuuaacaacuccaacaugguucuuuggacuuc

SEQ ID NO: 1656 - RNA, 351 nt, artificial sequence
  synthetic construct
gagcauuaaguucauuccuuugagcuuguaaccuacgaagauuuugacuuuuuucagcuacaauaagcuguaacucuucaauuuuggugauauaauaugaucuaaauccuucaccuuugagggccccauccaccuccauucucugugguguuucuacacuuguagccaugucuaccgguauuucagauugugguuuguuuucuaaauuuuuugaacugucuucuauagaagauuuuuucuuuuuguuucuuuuaaauuuugcaagggacccacuuugucccauuuuaccaaaauuuuugaaaaauauuaaugaaauaaugacauuuugaaaauaacaaaagacaaacugac

SEQ ID NO: 1657 - RNA, 351 nt, artificial sequence
  synthetic construct
gcugugcaaacacccuuaacuucagccccgcuagcaccuggcauuaauucagcgauuuuccuuaaauugauaccucuaguuagauucauuuuucucgaaugaauuuucaaaauguccaaucuggcuucuucguucgguggagggaacucaauuuuucugucaauucuuccaggucuaagcaaagcaggaucaagaaugucuauucuguugguagccaugaugacuuuaauguuuuugguugcuucaaaaccaucaagcugauuuaacaacuccaacaugguucuuuggacuucagaaucaccaccagagccagauucaauacgagaagauccuauagaaucaauuucgucc

SEQ ID NO: 1658 - RNA, 351 nt, artificial sequence
  synthetic construct
guuuuucugucaauucuuccaggucuaagcaaagcaggaucaagaaugucuauucuguugguagccaugaugacuuuaauguuuuugguugcuucaaaaccaucaagcugauuuaacaacuccaacaugguucuuuggacuucagaaucaccaccagagccagauucaauacgagaagauccuauagaaucaauuucguccaugaaaaugauggaaggugcaugcucucuggccauaacgaagagcucccugaccauucuggagcccucuccaaugaauuuuugaaccaauucugaaccagauacucgaaugaauguacauucuguaugaugagcuacugcucuggccaac

SEQ ID NO: 1659 - RNA, 351 nt, artificial sequence
  synthetic construct
gcguauguagaaucagguacuuuuucuaccaucauaagugauacuaaugggucaaccuuauuggguaaaaucuuaugcaauguguaugauucauuucuaagggcuacucuacaauuuggugugacaucauuaaugucaauguuuuuaucgauaucaacaacaaauuuuccuucaggguguacuuugacaaguacuuuuuucuuguccauggguuuuacaacuucaccaacauagcuucccuguucuugaagaagcaucaguucuucucuaagcauacgaacuuuagcauuaaguucauuccuuugagcuuguaaccuacgaagauuuugacuuuuuucagcuacaauaagc

SEQ ID NO: 1660 - RNA, 352 nt, artificial sequence
  synthetic construct
guuuaucuaaaccuccaaccauuucguauguagaaucagguacuuuuucuaccaucauaagugauacuaaugggucaaccuuauuggguaaaaucuuaugcaauguguaugauucauuucuaagggcuacucuacaauuuggugugacaucauuaaugucaauguuuuuaucgauaucaacaacaaauuuuccuucaggguguacuuugacaaguacuuuuuucuuguccauggguuuuacaacuucaccaacauagcuucccuguucuugaagaagcaucaguucuucucuaagcauacgaacuuuagcauuaaguucauuccuuugagcuuguaaccuacgaagauuuuc

SEQ ID NO: 1661 - RNA, 351 nt, artificial sequence
  synthetic construct
guucaaaauguccaaucuggcuucuucguucgguggagggaacucaauuuuucugucaauucuuccaggucuaagcaaagcaggaucaagaaugucuauucuguugguagccaugaugacuuuaauguuuuugguugcuucaaaaccaucaagcugauuuaacaacuccaacaugguucuuuggacuucagaaucaccaccagagccagauucaauacgagaagauccuauagaaucaauuucguccaugaaaaugauggaaggugcaugcucucuggccauaacgaagagcucccugaccauucuggagcccucuccaaugaauuuuugaaccaauucugaaccagauac

SEQ ID NO: 1662 - RNA, 351 nt, artificial sequence
  synthetic construct
gucuugugucacaugaacccuucucucccucaaagcguacauacccgccucugugcaaacacccuuaacuucagccccgcuagcaccuggcauuaauucagcgauuuuccuuaaauugauaccucuaguuagauucauuuuucucgaaugaauuuucaaaauguccaaucuggcuucuucguucgguggagggaacucaauuuuucugucaauucuuccaggucuaagcaaagcaggaucaagaaugucuauucuguugguagccaugaugacuuuaauguuuuugguugcuucaaaaccaucaagcugauuuaacaacuccaacaugguucuuuggacuucagaaucacc

SEQ ID NO: 1663 - RNA, 352 nt, artificial sequence
  synthetic construct
guuuguuuaucuaaaccuccaaccauuucguauguagaaucagguacuuuuucuaccaucauaagugauacuaaugggucaaccuuauuggguaaaaucuuaugcaauguguaugauucauuucuaagggcuacucuacaauuuggugugacaucauuaaugucaauguuuuuaucgauaucaacaacaaauuuuccuucaggguguacuuugacaaguacuuuuuucuuguccauggguuuuacaacuucaccaacauagcuucccuguucuugaagaagcaucaguucuucucuaagcauacgaacuuuagcauuaaguucauuccuuugagcuuguaaccuacgaagac

SEQ ID NO: 1664 - RNA, 351 nt, artificial sequence
  synthetic construct
guuuacuggcagcucaauaaccucuuugauuucuuuaauuuguuuaucuaaaccuccaaccauuucguauguagaaucagguacuuuuucuaccaucauaagugauacuaaugggucaaccuuauuggguaaaaucuuaugcaauguguaugauucauuucuaagggcuacucuacaauuuggugugacaucauuaaugucaauguuuuuaucgauaucaacaacaaauuuuccuucaggguguacuuugacaaguacuuuuuucuuguccauggguuuuacaacuucaccaacauagcuucccuguucuugaagaagcaucaguucuucucuaagcauacgaacuuuagc

SEQ ID NO: 1665 - RNA, 352 nt, artificial sequence
  synthetic construct
guaaauucacacaaaugugccaaaccugacucuuuagcuucuggauugucuucaauaauaguuaugauaguaucagcaauagaugcuuuauauuccagaccuccuucaucucuuaacauggcugacaggaaauucauuagugugcuauguuugcgaggaaacuugagagcuagugccuugauggcuuggacaacuacaacuuugaauucaucacugauuucagaaacgaaacuugcaauuuguuucaugagacggucuacagaugauucagcaccaguuuuuaacagaguaguuauagccaaaguagcaauugaucuguuagaaucaguaaucaaguuuucuaaaucuagac

SEQ ID NO: 1666 - RNA, 350 nt, artificial sequence
  synthetic construct
gaaccugaucaguucgcucagcagcugccaacccaagaaauuguauaauauucuuuacagccucaucuaaaguguucauugaacugagagaauaaguaucuucuuuuucuacugagccuucugcugccuugucccaggccgcggcccaauugacuuugccuacccuuuggauuugauccccaagaguuacuucaaggucuucaagcauguacucuucuucguaaccaucuucacagucugguauuccagugguaggaucacaauccuugacaacaaauuuaagaacagcuccaaagguucccacacaacuuguuagaucaucaucagggaauuucaguaucacauauguc

SEQ ID NO: 1667 - RNA, 352 nt, artificial sequence
  synthetic construct
guucugaucaacauacaagcagcauauggagauuucaaagacauucuagucaaucuggcuauuaauuuuguuacagccaaccgaucugucuuucuaauaugauaaaguaguccuaaugcaugauauuguaccaucacauugucacuguuaauugcuucuugugccucauuaacccaucuuuuaacuacuucuggggccauucuagucaugugcaaggaacugacaagagcagcagaacuaacagccgaguuccuaucuacuauagcuugcuucauauaucguucuauugcuuguaacauuguagcaucagugauacugcaaagagcccuaauugcggcugcucgguagauac

SEQ ID NO: 1668 - RNA, 351 nt, artificial sequence
  synthetic construct
gcccaacaaaugcaaaauucuuacagcuaaagaaacauguucacaaucuucaauaaauucacacaaaugugccaaaccugacucuuuagcuucuggauugucuucaauaauaguuaugauaguaucagcaauagaugcuuuauauuccagaccuccuucaucucuuaacauggcugacaggaaauucauuagugugcuauguuugcgaggaaacuugagagcuagugccuugauggcuuggacaacuacaacuuugaauucaucacugauuucagaaacgaaacuugcaauuuguuucaugagacggucuacagaugauucagcaccaguuuuuaacagaguaguuauagc

SEQ ID NO: 1669 - RNA, 351 nt, artificial sequence
  synthetic construct
gauaacucgauuguagaugaaacggauguaucuugaagguugcuuugucuuuggacccucucuucccaacaaaugcaaaauucuuacagcuaaagaaacauguucacaaucuucaauaaauucacacaaaugugccaaaccugacucuuuagcuucuggauugucuucaauaauaguuaugauaguaucagcaauagaugcuuuauauuccagaccuccuucaucucuuaacauggcugacaggaaauucauuagugugcuauguuugcgaggaaacuugagagcuagugccuugauggcuuggacaacuacaacuuugaauucaucacugauuucagaaacgaaacuugc

SEQ ID NO: 1670 - RNA, 352 nt, artificial sequence
  synthetic construct
guaguaucagcaauagaugcuuuauauuccagaccuccuucaucucuuaacauggcugacaggaaauucauuagugugcuauguuugcgaggaaacuugagagcuagugccuugauggcuuggacaacuacaacuuugaauucaucacugauuucagaaacgaaacuugcaauuuguuucaugagacggucuacagaugauucagcaccaguuuuuaacagaguaguuauagccaaaguagcaauugaucuguuagaaucaguaaucaaguuuucuaaaucuagauugcaagcuguaacagcugcagggugagaaauagcuacuugauuuaauguucugacugcagcaaauc

SEQ ID NO: 1671 - RNA, 351 nt, artificial sequence
  synthetic construct
gcccaagaaauuguauaauauucuuuacagccucaucuaaaguguucauugaacugagagaauaaguaucuucuuuuucuacugagccuucugcugccuugucccaggccgcggcccaauugacuuugccuacccuuuggauuugauccccaagaguuacuucaaggucuucaagcauguacucuucuucguaaccaucuucacagucugguauuccagugguaggaucacaauccuugacaacaaauuuaagaacagcuccaaagguucccacacaacuuguuagaucaucaucagggaauuucaguaucacauaugucguccccguuugguuguaaugcaacuguucgc

SEQ ID NO: 1672 - RNA, 351 nt, artificial sequence
  synthetic construct
gucauauaucguucuauugcuuguaacauuguagcaucagugauacugcaaagagcccuaauugcggcugcucgguagauaucuucuuuuccagucauauccuugguaagacuagaagugacuauaaucacaucaucggcaguagaacucaauucuuuuauucccaaauagaccauucuucguaaaauuacgucuuucgauuggaauaauuuggucauugcaaagaaaacaucuguagcuucuuugacacugaggcuuucacccugguucaaaagauaaaguaguuuuguaagaauagggguacauuuucuuggauuuacacuuguuucauuaaaaacccgagcuucuugc

SEQ ID NO: 1673 - RNA, 352 nt, artificial sequence
  synthetic construct
guauaauauucuuuacagccucaucuaaaguguucauugaacugagagaauaaguaucuucuuuuucuacugagccuucugcugccuugucccaggccgcggcccaauugacuuugccuacccuuuggauuugauccccaagaguuacuucaaggucuucaagcauguacucuucuucguaaccaucuucacagucugguauuccagugguaggaucacaauccuugacaacaaauuuaagaacagcuccaaagguucccacacaacuuguuagaucaucaucagggaauuucaguaucacauaugucguccccguuugguuguaaugcaacuguucgcaggguauuucagc

SEQ ID NO: 1674 - RNA, 352 nt, artificial sequence
  synthetic construct
guacuucaaggucuucaagcauguacucuucuucguaaccaucuucacagucugguauuccagugguaggaucacaauccuugacaacaaauuuaagaacagcuccaaagguucccacacaacuuguuagaucaucaucagggaauuucaguaucacauaugucguccccguuugguuguaaugcaacuguucgcaggguauuucagccaaaauuucaaaguuuucauuaggguccaaaucgacccuaacauuuuccaagaguugaucagcaagaguguucaaacaaucgaauuguaaaacgauauggugagcaaaacaguguuugauacaacguacaaaauacucaguuuc

SEQ ID NO: 1675 - RNA, 351 nt, artificial sequence
  synthetic construct
guuucaaagacauucuagucaaucuggcuauuaauuuuguuacagccaaccgaucugucuuucuaauaugauaaaguaguccuaaugcaugauauuguaccaucacauugucacuguuaauugcuucuugugccucauuaacccaucuuuuaacuacuucuggggccauucuagucaugugcaaggaacugacaagagcagcagaacuaacagccgaguuccuaucuacuauagcuugcuucauauaucguucuauugcuuguaacauuguagcaucagugauacugcaaagagcccuaauugcggcugcucgguagauaucuucuuuuccagucauauccuugguaagac

SEQ ID NO: 1676 - RNA, 351 nt, artificial sequence
  synthetic construct
guacuuuuucuucucauccuucuuugcauccuuauccuuuucucccuuuuccuuaucuuuaucuuuacuauccuuauccuuacuguccuuaucuuuauccuuacuauccuucuucucuucuuucuuacccuccucagcaucuuuguuugucaguuuguuauugauuaaauuaugcaaugccacuauggaucuaaccagagcugcuaaguagacuacaagcaucugaucauuguuuuuaacauaaaaugaauuguuaaaagcaucuugguuuauaucaggcagcaaauugaaaauaucuuguaacugauagauaauuugaugauuaauagguagcguauugucacaaacauc

SEQ ID NO: 1677 - RNA, 351 nt, artificial sequence
  synthetic construct
guaucuuuaucuuuacuauccuuauccuuacuguccuuaucuuuauccuuacuauccuucuucucuucuuucuuacccuccucagcaucuuuguuugucaguuuguuauugauuaaauuaugcaaugccacuauggaucuaaccagagcugcuaaguagacuacaagcaucugaucauuguuuuuaacauaaaaugaauuguuaaaagcaucuugguuuauaucaggcagcaaauugaaaauaucuuguaacugauagauaauuugaugauuaauagguagcguauugucacaaacauuuaacaaauagucucuaaugucuuucaacugugaaugcagucccuucagaccc

SEQ ID NO: 1678 - RNA, 352 nt, artificial sequence
  synthetic construct
guucuucucauccuucuuugcauccuuauccuuuucucccuuuuccuuaucuuuaucuuuacuauccuuauccuuacuguccuuaucuuuauccuuacuauccuucuucucuucuuucuuacccuccucagcaucuuuguuugucaguuuguuauugauuaaauuaugcaaugccacuauggaucuaaccagagcugcuaaguagacuacaagcaucugaucauuguuuuuaacauaaaaugaauuguuaaaagcaucuugguuuauaucaggcagcaaauugaaaauaucuuguaacugauagauaauuugaugauuaauagguagcguauugucacaaacauuuaacaac

SEQ ID NO: 1679 - RNA, 352 nt, artificial sequence
  synthetic construct
gucauuaauagcaaugucguuuugguguaauuuggguccggugugguaccagcccacuacacguucucuagcauugacuuuuuuaaacaugccguacauauuuucuaaguaaucaugguccaaaaaccacacagauugaucuuugucauccucaucaaaaggaacugcgaaacuauucgaaacauccaagacuccuuuagcccuccaacaaccgaguaagacaccgacgacgcguuuuugguuaccgauuuuucccauacgauugaaaugauccacuacgcuaaguaagaccaauggauggacuauaacuuuaguugucguuacgucugaacuaggcauuuuaaagcccguc

SEQ ID NO: 1680 - RNA, 350 nt, artificial sequence
  synthetic construct
gcagcaaauugaaaauaucuuguaacugauagauaauuugaugauuaauagguagcguauugucacaaacauuuaacaaauagucucuaaugucuuucaacugugaaugcagucccuucagacccaacaauugauuuguaauucuuugagaaagugugccaacaguaguaucuuugauaucacguaauaaauguucuacacccacuucuucagccucuucugcuccaauuucgcuugguacguguucaaaaguuuuggauguuggugaaccaucaucauguacuuccucaacggcuugauacgcuucugugggaaggccuaagucuuuugguuuggcaucaauaauuacc

SEQ ID NO: 1681 - RNA, 351 nt, artificial sequence
  synthetic construct
gccucagcaucuuuguuugucaguuuguuauugauuaaauuaugcaaugccacuauggaucuaaccagagcugcuaaguagacuacaagcaucugaucauuguuuuuaacauaaaaugaauuguuaaaagcaucuugguuuauaucaggcagcaaauugaaaauaucuuguaacugauagauaauuugaugauuaauagguagcguauugucacaaacauuuaacaaauagucucuaaugucuuucaacugugaaugcagucccuucagacccaacaauugauuuguaauucuuugagaaagugugccaacaguaguaucuuugauaucacguaauaaauguucuacaccc

SEQ ID NO: 1682 - RNA, 352 nt, artificial sequence
  synthetic construct
gucuuugcauccuuauccuuuucucccuuuuccuuaucuuuaucuuuacuauccuuauccuuacuguccuuaucuuuauccuuacuauccuucuucucuucuuucuuacccuccucagcaucuuuguuugucaguuuguuauugauuaaauuaugcaaugccacuauggaucuaaccagagcugcuaaguagacuacaagcaucugaucauuguuuuuaacauaaaaugaauuguuaaaagcaucuugguuuauaucaggcagcaaauugaaaauaucuuguaacugauagauaauuugaugauuaauagguagcguauugucacaaacauuuaacaaauagucucuaaugc

SEQ ID NO: 1683 - RNA, 352 nt, artificial sequence
  synthetic construct
guggucuuuggugacuucgccuagacguuuacgggcuucuucuaaaacagcacggacaugaucuucucucacuuuuagaaccuucaaccuugccugguucaacauguuggaagauuggauuuucuuuuguaauucgaccugcuuuuccuucuuuucauaauauuccauaauuuugagccucuguuguugaacgagacgucccuucucgauguugaacuccuccucagccuuagcaucgauuucuucagcuuuuucauuggcuucuugcucaaugaaagccaucauauguuugaucuguuuuuggacaucugcgucacuuaaagccauuuugguugauuuguagaaacgauuc

SEQ ID NO: 1684 - RNA, 352 nt, artificial sequence
  synthetic construct
guuaaucuugaucuuguuccucaaggcaaggaguucaauuccuccggugguuucuugagauagaugggacugaucaucgauuuucaagacuaugucuuugccugugauauccuuguauuugguuuggacauuguucaagaucgauuuuaccaauucucuaucuuguggacgcacucugacggucaccucuuuuucaaagagcugguacaauccuuggagaaucaagcuuucaauaaucugaccauauuuuccuuggucuuuggugacuucgccuagacguuuacgggcuucuucuaaaacagcacggacaugaucuucucucacuuuuagaaccuucaaccuugccugguuc

SEQ ID NO: 1685 - RNA, 352 nt, artificial sequence
  synthetic construct
guucucuaucuuguggacgcacucugacggucaccucuuuuucaaagagcugguacaauccuuggagaaucaagcuuucaauaaucugaccauauuuuccuuggucuuuggugacuucgccuagacguuuacgggcuucuucuaaaacagcacggacaugaucuucucucacuuuuagaaccuucaaccuugccugguucaacauguuggaagauuggauuuucuuuuguaauucgaccugcuuuuccuucuuuucauaauauuccauaauuuugagccucuguuguugaacgagacgucccuucucgauguugaacuccuccucagccuuagcaucgauuucuucagcuuc

SEQ ID NO: 1686 - RNA, 352 nt, artificial sequence
  synthetic construct
guucaagacuaugucuuugccugugauauccuuguauuugguuuggacauuguucaagaucgauuuuaccaauucucuaucuuguggacgcacucugacggucaccucuuuuucaaagagcugguacaauccuuggagaaucaagcuuucaauaaucugaccauauuuuccuuggucuuuggugacuucgccuagacguuuacgggcuucuucuaaaacagcacggacaugaucuucucucacuuuuagaaccuucaaccuugccugguucaacauguuggaagauuggauuuucuuuuguaauucgaccugcuuuuccuucuuuucauaauauuccauaauuuugagccuc

SEQ ID NO: 1687 - RNA, 352 nt, artificial sequence
  synthetic construct
guaccaauucucuaucuuguggacgcacucugacggucaccucuuuuucaaagagcugguacaauccuuggagaaucaagcuuucaauaaucugaccauauuuuccuuggucuuuggugacuucgccuagacguuuacgggcuucuucuaaaacagcacggacaugaucuucucucacuuuuagaaccuucaaccuugccugguucaacauguuggaagauuggauuuucuuuuguaauucgaccugcuuuuccuucuuuucauaauauuccauaauuuugagccucuguuguugaacgagacgucccuucucgauguugaacuccuccucagccuuagcaucgauuucuuc

SEQ ID NO: 1688 - RNA, 352 nt, artificial sequence
  synthetic construct
guuuuaccaauucucuaucuuguggacgcacucugacggucaccucuuuuucaaagagcugguacaauccuuggagaaucaagcuuucaauaaucugaccauauuuuccuuggucuuuggugacuucgccuagacguuuacgggcuucuucuaaaacagcacggacaugaucuucucucacuuuuagaaccuucaaccuugccugguucaacauguuggaagauuggauuuucuuuuguaauucgaccugcuuuuccuucuuuucauaauauuccauaauuuugagccucuguuguugaacgagacgucccuucucgauguugaacuccuccucagccuuagcaucgauuuc

SEQ ID NO: 1689 - RNA, 351 nt, artificial sequence
  synthetic construct
guggauaguaaaaaucuagcuugagaaccgcccuguucgguaucgauguaucucggcaugggaaaucucgucugcaauauuuccugagcaucguccacgggugcuuguaacaguugucuaaaguuuucguauuccggcauaucuugguauuucaaguuacgccacugagcuauugucucuccguggaauaucaauauuuggaagaaaguguccaucaauaauauccucuccgauugaaucgaacucguauccaacagaacggguuccgggggcccguugaagcuguaacuguacaaaaucggcuggaucauaaucaaagacugcgucagaucuucucucauuaacaugugc

SEQ ID NO: 1690 - RNA, 352 nt, artificial sequence
  synthetic construct
guaaauaucaacacaaugcccauuaguugcugcucucauagccaaagcaucauaaugcuuuauaccuuuuuucauauacuuugcauuaucuuuuugaauaucaugaugagaucuaauagguuguuuuaaaucaucauucaaaaccugaccaggcccuugagagcacgguccuccaacaaaaagcauaacucuagcuccuguauugggauaagugcucuccaacaaaccaauagcuauagauaaagcaacaccgguacaucuaagagaucucuuucccugaugaacaggccagggaucuuuuugcugcucuccuauuaaaucaguuaaauucauaucgcauuuagauacaggc

SEQ ID NO: 1691 - RNA, 352 nt, artificial sequence
  synthetic construct
guaaucaaaccaauuaaagcauucggaggcaauaaacugagugacauuuguaaagaaucuuuaagugaacccaauucuuccucauccaugcaaguaucaacaacauacaagaauaucggugguaaacacugagcucuaguaauaguauacucaauaguugaaaacauaggcauuaacucagcagguugaugcuguucagaaauagcugcauauugagguggaaacggauugcguugaaaacaaaaauugcaaacccacaauuuugcucgauaaucaacuuggcacauaggauuuaaaaucgcucugcaguuauuucuuguacacagaacgggaucauacuguauggguggac

SEQ ID NO: 1692 - RNA, 350 nt, artificial sequence
  synthetic construct
gagcuauugucucuccguggaauaucaauauuuggaagaaaguguccaucaauaauauccucuccgauugaaucgaacucguauccaacagaacggguuccgggggcccguugaagcuguaacuguacaaaaucggcuggaucauaaucaaagacugcgucagaucuucucucauuaacaugugccgauaauacgacguuucguccggugaauuauugaaaacuugcaggaauugagaacgucucagaugguacaugaauuggggauagaggcuaaaguuuugacccaaucugaacgaauucgcgucguccuuguuguauucuccgaauuuuugacacaaucuaaucaac

SEQ ID NO: 1693 - RNA, 352 nt, artificial sequence
  synthetic construct
guuuacauucaaugauacgcaagaaccaaucccuccuugcacuuucaauucucuagaacauuucacuuccagagucccguugaaagccauuuuuaauucgcccuuuugaucuuuggugaacacccguuggaaugucuguuugaauagggaggaauugaaugaaucucccauuaccaugugaccgccuguagaauugcagcacuguuucaucuccaucaaaccagucugauccaaagcacaagaauaaauaucaacacaaugcccauuaguugcugcucucauagccaaagcaucauaaugcuuuauaccuuuuuucauauacuuugcauuaucuuuuugaauaucaugaugc

SEQ ID NO: 1694 - RNA, 350 nt, artificial sequence
  synthetic construct
gcacuuucaauucucuagaacauuucacuuccagagucccguugaaagccauuuuuaauucgcccuuuugaucuuuggugaacacccguuggaaugucuguuugaauagggaggaauugaaugaaucucccauuaccaugugaccgccuguagaauugcagcacuguuucaucuccaucaaaccagucugauccaaagcacaagaauaaauaucaacacaaugcccauuaguugcugcucucauagccaaagcaucauaaugcuuuauaccuuuuuucauauacuuugcauuaucuuuuugaauaucaugaugagaucuaauagguuguuuuaaaucaucauucaaaacc

SEQ ID NO: 1695 - RNA, 352 nt, artificial sequence
  synthetic construct
gauaaauaucaacacaaugcccauuaguugcugcucucauagccaaagcaucauaaugcuuuauaccuuuuuucauauacuuugcauuaucuuuuugaauaucaugaugagaucuaauagguuguuuuaaaucaucauucaaaaccugaccaggcccuugagagcacgguccuccaacaaaaagcauaacucuagcuccuguauugggauaagugcucuccaacaaaccaauagcuauagauaaagcaacaccgguacaucuaagagaucucuuucccugaugaacaggccagggaucuuuuugcugcucuccuauuaaaucaguuaaauucauaucgcauuuagauacagc

SEQ ID NO: 1696 - RNA, 352 nt, artificial sequence
  synthetic construct
guaauucaugaacuuggaccauuuuuccaaauguaaucaaaccaauuaaagcauucggaggcaauaaacugagugacauuuguaaagaaucuuuaagugaacccaauucuuccucauccaugcaaguaucaacaacauacaagaauaucggugguaaacacugagcucuaguaauaguauacucaauaguugaaaacauaggcauuaacucagcagguugaugcuguucagaaauagcugcauauugagguggaaacggauugcguugaaaacaaaaauugcaaacccacaauuuugcucgauaaucaacuuggcacauaggauuuaaaaucgcucugcaguuauuucuugc

SEQ ID NO: 1697 - RNA, 351 nt, artificial sequence
  synthetic construct
gcaaagcacaagaauaaauaucaacacaaugcccauuaguugcugcucucauagccaaagcaucauaaugcuuuauaccuuuuuucauauacuuugcauuaucuuuuugaauaucaugaugagaucuaauagguuguuuuaaaucaucauucaaaaccugaccaggcccuugagagcacgguccuccaacaaaaagcauaacucuagcuccuguauugggauaagugcucuccaacaaaccaauagcuauagauaaagcaacaccgguacaucuaagagaucucuuucccugaugaacaggccagggaucuuuuugcugcucuccuauuaaaucaguuaaauucauaucgc

SEQ ID NO: 1698 - RNA, 352 nt, artificial sequence
  synthetic construct
gaacauaggcauuaacucagcagguugaugcuguucagaaauagcugcauauugagguggaaacggauugcguugaaaacaaaaauugcaaacccacaauuuugcucgauaaucaacuuggcacauaggauuuaaaaucgcucugcaguuauuucuuguacacagaacgggaucauacuguauggguggaagaucuaaacguucuuuaaucgguugauaaagacacgcuaaugguacuaccaaacgaguugcuucuauccuacucgauggccauacauuccaaguaaaucugauuccaucucggucuucguuuuguugaauguauucuucguaaguacucauuuuuugaauc

SEQ ID NO: 1699 - RNA, 352 nt, artificial sequence
  synthetic construct
guaugguacucacucugauccuucucugaccauuagaaugcugauauugaguaauaaauuguaugcauccucuuccuccuugaggaaucggugcagaaugcugauugaccacuucgaaaaacagcgcuauagugguacuuggaguuaaagugcacauuuuccauugcaccguauuucccauaccgauuucgguauccgaaacaagcggaccuuuuacauucaaugauacgcaagaaccaaucccuccuugcacuuucaauucucuagaacauuucacuuccagagucccguugaaagccauuuuuaauucgcccuuuugaucuuuggugaacacccguuggaaugucuguuc

SEQ ID NO: 1700 - RNA, 351 nt, artificial sequence
  synthetic construct
guaguggguuuuugcugcuagccucuuaucucuuucuucagcuauggacaacuuaacucccuuuccucuuggaagagauacaaaagcuuuggcucccuuaccaauuaugaauacauuauguaaccuaguagcaaacacguggccauuagcauccuuaauguguacaauaucaaaggauccuggaugacguucccuauugauuaccguaccaacacgacccaaauuucuaccuccaguaaucauacacaaguuaccagauucaaacuuaauguaguccaggauuuuagauguggcaauuuccaauugaauggugucauuuacuuugauguuggggucgggauaacgaagugc

SEQ ID NO: 1701 - RNA, 350 nt, artificial sequence
  synthetic construct
guggccauuagcauccuuaauguguacaauaucaaaggauccuggaugacguucccuauugauuaccguaccaacacgacccaaauuucuaccuccaguaaucauacacaaguuaccagauucaaacuuaauguaguccaggauuuuagauguggcaauuuccaauugaauggugucauuuacuuugauguuggggucgggauaacgaaguguauguccaucauguguuacaaugaaugguauauuuuuugguccagucuggacucuccuaauuuugcaaaguuuguauuuagcuucuucagcuguuauacggugaauggcaaaccuuccuuuuacaucauaaauaagac

SEQ ID NO: 1702 - RNA, 352 nt, artificial sequence
  synthetic construct
guggccauuagcauccuuaauguguacaauaucaaaggauccuggaugacguucccuauugauuaccguaccaacacgacccaaauuucuaccuccaguaaucauacacaaguuaccagauucaaacuuaauguaguccaggauuuuagauguggcaauuuccaauugaauggugucauuuacuuugauguuggggucgggauaacgaaguguauguccaucauguguuacaaugaaugguauauuuuuugguccagucuggacucuccuaauuuugcaaaguuuguauuuagcuucuucagcuguuauacggugaauggcaaaccuuccuuuuacaucauaaauaagacgc

SEQ ID NO: 1703 - RNA, 351 nt, artificial sequence
  synthetic construct
gcguucccuauugauuaccguaccaacacgacccaaauuucuaccuccaguaaucauacacaaguuaccagauucaaacuuaauguaguccaggauuuuagauguggcaauuuccaauugaauggugucauuuacuuugauguuggggucgggauaacgaaguguauguccaucauguguuacaaugaaugguauauuuuuugguccagucuggacucuccuaauuuugcaaaguuuguauuuagcuucuucagcuguuauacggugaauggcaaaccuuccuuuuacaucauaaauaagacggaaaaauucuccaguuuuuucaauggugauaacauccauaaauccagc

SEQ ID NO: 1704 - RNA, 352 nt, artificial sequence
  synthetic construct
gucuuaucucuuucuucagcuauggacaacuuaacucccuuuccucuuggaagagauacaaaagcuuuggcucccuuaccaauuaugaauacauuauguaaccuaguagcaaacacguggccauuagcauccuuaauguguacaauaucaaaggauccuggaugacguucccuauugauuaccguaccaacacgacccaaauuucuaccuccaguaaucauacacaaguuaccagauucaaacuuaauguaguccaggauuuuagauguggcaauuuccaauugaauggugucauuuacuuugauguuggggucgggauaacgaaguguauguccaucauguguuacaaugc

SEQ ID NO: 1705 - RNA, 351 nt, artificial sequence
  synthetic construct
ggccauuagcauccuuaauguguacaauaucaaaggauccuggaugacguucccuauugauuaccguaccaacacgacccaaauuucuaccuccaguaaucauacacaaguuaccagauucaaacuuaauguaguccaggauuuuagauguggcaauuuccaauugaauggugucauuuacuuugauguuggggucgggauaacgaaguguauguccaucauguguuacaaugaaugguauauuuuuugguccagucuggacucuccuaauuuugcaaaguuuguauuuagcuucuucagcuguuauacggugaauggcaaaccuuccuuuuacaucauaaauaagacggc

SEQ ID NO: 1706 - RNA, 350 nt, artificial sequence
  synthetic construct
gauccuggaugacguucccuauugauuaccguaccaacacgacccaaauuucuaccuccaguaaucauacacaaguuaccagauucaaacuuaauguaguccaggauuuuagauguggcaauuuccaauugaauggugucauuuacuuugauguuggggucgggauaacgaaguguauguccaucauguguuacaaugaaugguauauuuuuugguccagucuggacucuccuaauuuugcaaaguuuguauuuagcuucuucagcuguuauacggugaauggcaaaccuuccuuuuacaucauaaauaagacggaaaaauucuccaguuuuuucaauggugauaacauc

SEQ ID NO: 1707 - RNA, 352 nt, artificial sequence
  synthetic construct
guaugaauacauuauguaaccuaguagcaaacacguggccauuagcauccuuaauguguacaauaucaaaggauccuggaugacguucccuauugauuaccguaccaacacgacccaaauuucuaccuccaguaaucauacacaaguuaccagauucaaacuuaauguaguccaggauuuuagauguggcaauuuccaauugaauggugucauuuacuuugauguuggggucgggauaacgaaguguauguccaucauguguuacaaugaaugguauauuuuuugguccagucuggacucuccuaauuuugcaaaguuuguauuuagcuucuucagcuguuauacggugaac

SEQ ID NO: 1708 - RNA, 352 nt, artificial sequence
  synthetic construct
gcaauuaugaauacauuauguaaccuaguagcaaacacguggccauuagcauccuuaauguguacaauaucaaaggauccuggaugacguucccuauugauuaccguaccaacacgacccaaauuucuaccuccaguaaucauacacaaguuaccagauucaaacuuaauguaguccaggauuuuagauguggcaauuuccaauugaauggugucauuuacuuugauguuggggucgggauaacgaaguguauguccaucauguguuacaaugaaugguauauuuuuugguccagucuggacucuccuaauuuugcaaaguuuguauuuagcuucuucagcuguuauacggc

SEQ ID NO: 1709 - RNA, 352 nt, artificial sequence
  synthetic construct
guaaccuaguagcaaacacguggccauuagcauccuuaauguguacaauaucaaaggauccuggaugacguucccuauugauuaccguaccaacacgacccaaauuucuaccuccaguaaucauacacaaguuaccagauucaaacuuaauguaguccaggauuuuagauguggcaauuuccaauugaauggugucauuuacuuugauguuggggucgggauaacgaaguguauguccaucauguguuacaaugaaugguauauuuuuugguccagucuggacucuccuaauuuugcaaaguuuguauuuagcuucuucagcuguuauacggugaauggcaaaccuuccuuc

SEQ ID NO: 1710 - RNA, 350 nt, artificial sequence
  synthetic construct
gguauacucuuacaauaccuccugaauaagcaucucuauggguagcaugauagauagaccugcgaccuaaaucauaugcuucuucgucugucaaaucccauuuguaaccugaaucgagcacaccaaaagcauagauggaaccugaaccuacacugaacacuuuuccagguguucuaagcccuucagaaucgacauaguaaaguugaggaccccucuugucccaaccagccaacaucauucccauagauaaccccauucccuuguaauuguaaaccauguuggccaucaacuuagaagcagcugcaacagaaauucuuucccuauuucugaguucauacauucuacauugc

SEQ ID NO: 1711 - RNA, 350 nt, artificial sequence
  synthetic construct
guaagcaccacccucuuuagacuucuccucuugguacuuauagugcaaaucguuacaaucauuauuaucaauaaguucccagccagucuccuucaugugguauacucuuacaauaccuccugaauaagcaucucuauggguagcaugauagauagaccugcgaccuaaaucauaugcuucuucgucugucaaaucccauuuguaaccugaaucgagcacaccaaaagcauagauggaaccugaaccuacacugaacacuuuuccagguguucuaagcccuucagaaucgacauaguaaaguugaggaccccucuugucccaaccagccaacaucauucccauagauaacc

SEQ ID NO: 1712 - RNA, 352 nt, artificial sequence
  synthetic construct
guauacucuuacaauaccuccugaauaagcaucucuauggguagcaugauagauagaccugcgaccuaaaucauaugcuucuucgucugucaaaucccauuuguaaccugaaucgagcacaccaaaagcauagauggaaccugaaccuacacugaacacuuuuccagguguucuaagcccuucagaaucgacauaguaaaguugaggaccccucuugucccaaccagccaacaucauucccauagauaaccccauucccuuguaauuguaaaccauguuggccaucaacuuagaagcagcugcaacagaaauucuuucccuauuucugaguucauacauucuacauugcuuc

SEQ ID NO: 1713 - RNA, 352 nt, artificial sequence
  synthetic construct
gauacucuuacaauaccuccugaauaagcaucucuauggguagcaugauagauagaccugcgaccuaaaucauaugcuucuucgucugucaaaucccauuuguaaccugaaucgagcacaccaaaagcauagauggaaccugaaccuacacugaacacuuuuccagguguucuaagcccuucagaaucgacauaguaaaguugaggaccccucuugucccaaccagccaacaucauucccauagauaaccccauucccuuguaauuguaaaccauguuggccaucaacuuagaagcagcugcaacagaaauucuuucccuauuucugaguucauacauucuacauugcuuac

SEQ ID NO: 1714 - RNA, 352 nt, artificial sequence
  synthetic construct
guuagcuaaaacucgaucccaguauacacaaucugcugcuccuccagccaaaguacccaacagaaaaucauuaauuucuacaauuuucuucauaguuugcgacccaaugaauugaccuccuguugcccuagagucuacagcgaguacuacacccccuuuguacaugaaccccagaguaguuguaccauggucaaaauuaauuuugauuucacguccacugucguccuuuguaaauuuggcaaaauuauugcuuugauuuagaaaagggggcacugcuaaguccaugccauuaucgaaguuccugcaauaucuggacaagccaucaucgugcauuaaucuuucauaaucuagc

SEQ ID NO: 1715 - RNA, 352 nt, artificial sequence
  synthetic construct
guuaucaauaaguucccagccagucuccuucaugugguauacucuuacaauaccuccugaauaagcaucucuauggguagcaugauagauagaccugcgaccuaaaucauaugcuucuucgucugucaaaucccauuuguaaccugaaucgagcacaccaaaagcauagauggaaccugaaccuacacugaacacuuuuccagguguucuaagcccuucagaaucgacauaguaaaguugaggaccccucuugucccaaccagccaacaucauucccauagauaaccccauucccuuguaauuguaaaccauguuggccaucaacuuagaagcagcugcaacagaaauucuc

SEQ ID NO: 1716 - RNA, 352 nt, artificial sequence
  synthetic construct
guuuagacuucuccucuugguacuuauagugcaaaucguuacaaucauuauuaucaauaaguucccagccagucuccuucaugugguauacucuuacaauaccuccugaauaagcaucucuauggguagcaugauagauagaccugcgaccuaaaucauaugcuucuucgucugucaaaucccauuuguaaccugaaucgagcacaccaaaagcauagauggaaccugaaccuacacugaacacuuuuccagguguucuaagcccuucagaaucgacauaguaaaguugaggaccccucuugucccaaccagccaacaucauucccauagauaaccccauucccuuguaauc

SEQ ID NO: 1717 - RNA, 352 nt, artificial sequence
  synthetic construct
guuauuaucaauaaguucccagccagucuccuucaugugguauacucuuacaauaccuccugaauaagcaucucuauggguagcaugauagauagaccugcgaccuaaaucauaugcuucuucgucugucaaaucccauuuguaaccugaaucgagcacaccaaaagcauagauggaaccugaaccuacacugaacacuuuuccagguguucuaagcccuucagaaucgacauaguaaaguugaggaccccucuugucccaaccagccaacaucauucccauagauaaccccauucccuuguaauuguaaaccauguuggccaucaacuuagaagcagcugcaacagaaauc

SEQ ID NO: 1718 - RNA, 351 nt, artificial sequence
  synthetic construct
gcuucaugugguauacucuuacaauaccuccugaauaagcaucucuauggguagcaugauagauagaccugcgaccuaaaucauaugcuucuucgucugucaaaucccauuuguaaccugaaucgagcacaccaaaagcauagauggaaccugaaccuacacugaacacuuuuccagguguucuaagcccuucagaaucgacauaguaaaguugaggaccccucuugucccaaccagccaacaucauucccauagauaaccccauucccuuguaauuguaaaccauguuggccaucaacuuagaagcagcugcaacagaaauucuuucccuauuucugaguucauacauuc

SEQ ID NO: 1719 - DNA, 149 bp, artificial sequence
  synthetic construct
aagtactgcgatcgcgttaacgctttatcacgataccttctaccacatatcactaacaacatcaacactcatcatctagactctcgacgacatccactcgtcactactctcacacgaccgattaactcctcatccacgcggccgcgagc

SEQ ID NO: 1720 - DNA, 150 bp, artificial sequence
  synthetic construct
aagtactgcgatcgcgttaacgctttatcacgataccttctaccacatatcactaacaacatcaacactcatcactctcgacgacatccactcgatcactactctcacacgaccgattaactcctcatccacgcggccgcctgcaggagc

SEQ ID NO: 1721 - DNA, 106 bp, artificial sequence
  synthetic construct
gcgtaacgtacgttacgcgtcgcgtcgatataattcgcgtcgttacggtattgcgctagaattcgcgtcgttatcgcgttcgcgatacggcgaaacgtactctaga

SEQ ID NO: 1722 - DNA, 640 bp, artificial sequence
  synthetic construct
gctttggatgatttctatgacaaaaacttccctgaatttataccgctaagaaccaaagttaaagaaatccttcaagaagaagacgaccttacggaaatcgtgcagctggtaggaaaagcttcattagctgaagctgataagattacattggaaatcgccaagctgttgaaagaagatttcctgcaacagaactcgtactcatcgtacgatagattctgtcccttctacaaaaccgtgggtatgttgaagaacatgattgggatgtacgcgtaacgtacgttacgcgtcgcgtcgatataattcgcgtcgttacggtattgcgctagaattcgcgtcgttatcgcgttcgcgatacggcgaaacgtactctagagtacatcccaatcatgttcttcaacatacccacggttttgtagaagggacagaatctatcgtacgatgagtacgagttctgttgcaggaaatcttctttcaacagcttggcgatttccaatgtaatcttatcagcttcagctaatgaagcttttcctaccagctgcacgatttccgtaaggtcgtcttcttcttgaaggatttctttaactttggttcttagcggtataaattcagggaagtttttgtcatagaaatcatccaaagc

SEQ ID NO: 1723 - RNA, 283 nt, artificial sequence
  synthetic construct
gggcgggugcuugucggucuucuugaagccgccgugguaguccucaaugaugggaucgaagauguccgcgaauacgguguacgauucagcgucgggggcguagauuccuacgccggagucgugguucuccaagccggauuggaugacaucaagaagagucgagccgaaagugggggucuucuuggucuucaaguugucgaagaucuccugggugaggugcuucuucagcagcgauuuggagucggaguccuugauuuucaugaaaccggauucaaguuugucc

SEQ ID NO: 1724 - RNA, 267 nt, artificial sequence
  synthetic construct
gcuuuggaugauuucuaugacaaaaacuucccugaauuuauaccgcuaagaaccaaaguuaaagaaauccuucaagaagaagacgaccuuacggaaaucgugcagcugguaggaaaagcuucauuagcugaagcugauaagauuacauuggaaaucgccaagcuguugaaagaagauuuccugcaacagaacucguacucaucguacgauagauucugucacuucuacaaaaccguggguauguugaagaacaugauugggauguac

SEQ ID NO: 1725 - RNA, 230 nt, artificial sequence
  synthetic construct
gcccgauuggacaucuugaaaauucacucgcgaaaaaugaauuugaccagagggaucaauuugaggaaaaucgccgaauugaugccaggugccagcggugccgaagugaagggaguguguacugaggcaggcauguacgcccuaagggagagaaggguacacguaacccaagaagauuucgaaauggcuguggccaaggucaugucgaaggagucagagaagaauauguc

SEQ ID NO: 1726 - RNA, 350 nt, artificial sequence
  synthetic construct
ggugauuauagaugcgaaaccuaaagaucuggggcuuccuacugaagcauaccaagcgguagaagagguccaugaugaugguucuccuacaucuaaaacguuugaacacgucccgagcgaaauaggcgcagaagaagccgaggaagucggaguagaacacuuacuaagagauauuaaagacacuacagugggaacuuuaucucaaaggauuacuaaucaguuauuaggccuuaaaggguugcauuugcaauugagagauauaagagacuauuugaugcaagugugcgauaacaaacugcccaucaaucaucagaucaucuaucaauugcaggauauuuucaauuuguugc

SEQ ID NO: 1727 - RNA, 267 nt, artificial sequence
  synthetic construct
gcuuuggaugauuucuaugacaaaaacuucccugaauuuauaccgcuaagaaccaaaguuaaagaaauccuacaagaagaagacgaccuuacggaaaucgugcagcugguaggaaaagcuucauuagcugaagcugauaagauuacauuggaaaucgccaagcuguugaaagaagauuuccugcaacagaacucguacucaucguacgauagauucuguccguucuacaaaaccguggguauguugaagaacaugauugggauguac

SEQ ID NO: 1728 - RNA, 352 nt, artificial sequence
  synthetic construct
gaguugcugucaguggugccgugcaagcagcugcauuacaacgaaaccaaucacaccuacgcuauuuugaaguuccccgacgacgauuugccuaguugcguugguacuuucggggcgguguugaaguuuaucguuaaagauugcgaucccaccacuggcauucccgauagcgaugaagguuacaaugaugaauacauacucgaagacuuggaaauaacguugggcgaucaaauacagagagugagcaaggucaauuggggcgccgcuugggaaucggcugcugaggguuccguggaaaaggaggauacguauucucucaguucgaugaauacguuggaugaagcugugaaac

SEQ ID NO: 1729 - RNA, 252 nt, artificial sequence
  synthetic construct
gauagaaugcugauucgauugugucaaaaauucggagaauacaauaaagacgaugcugguucauucagauuaggccaaaacuuuagccucuauccgcaauucauguaccaucuaaggaggucucaguucuugcagguuuucaauaauucuccugaugaaacgucguucuauagacauauguugaugagagaagaucuuacucaaucauugaucaugauucaaccaauuuuguacaguuauaguuucaacggc

SEQ ID NO: 1730 - RNA, 351 nt, artificial sequence
  synthetic construct
acgcacggagugcagcuucaaacgcacccgaaugucgauaaagaacuguucaaauugcguucagaaauugguuuaaaacagccuucgaaaccauucccgcuccacacugacguagguguauuaaaauggcguuugcaaaguacugacgaagcccuggugccacugcuaauaaacuguuggccuucagaagcaggagacggaaguugcgaugugaauauugaauacgaacuugcccauacuaacuuagaauuaguggacguuaacauuacaauuccuuuaccaauugguugcucuccaauagugggugaaugcgaugguucguacacucacgaagcaaaaagaaaucaucuc

SEQ ID NO: 1731 - RNA, 240 nt, artificial sequence
  synthetic construct
guccaugggcuugacuacuucuccuacguagcuuccuuguucuugaaggagcauuaguuccucucuaagcauacgaacuuuggcauugaguucguuccuuugggcuuguaaucuucuaagguucuggcuuuuuucagcaacgauuaguugcaauucuucuauuuugguaauguaguaggaccugaacccuucacccuugagagguccaucgaccuccaucuuauuaauuacagucauagc

SEQ ID NO: 1732 - RNA, 259 nt, artificial sequence
  synthetic construct
gggcaauucaaucaccucuuugaucucuuugauuugcuuauccagaccgccgaccauuucguaaguggaauccggcacuuuuucgaccaucauaagggacaccaaaggauccaccuuguuggguaggaucuugugcaaaguguaggauucguuucgaagggcgacucgacaauucggcguaacgucguugaugucgauguuuuugucgaugucgaccacgaauuuucccuccggguggacuuucaccagcacuuucuuc

SEQ ID NO: 1733 - RNA, 249 nt, artificial sequence
  synthetic construct
gauuucauccaugaaaaugaucgauggggcgugcucucuggccaucacgaacaguucucugaccauucgagaaccuucaccgaugaauuuuugcaccaacuccgaaccagauacucugauaaagguacauuccguguggugagccacggcucuggccagaagaguuuuaccgguucccggcggcccguacaacaacacacccuugggcugggcgaugcccaaggcaucgaacagcucgggaugcuucac

SEQ ID NO: 1734 - RNA, 245 nt, artificial sequence
  synthetic construct
gagugaauuuucaggauguccaaucgggcuuccucguucgguggcgggaacucgauuuuccugucgauucugccgggccucagcaaagccggauccaaaaugucgauucuguucguagccauuaucacuuuaauguucuucguggccucgaacccgucgagcugguucagcaacuccaacauaguccuuugaaccuccgaaucgccaccggaaccugauucgauacgcgaggauccgauagaauc

SEQ ID NO: 1735 - RNA, 246 nt, artificial sequence
  synthetic construct
gcaacagccauuucgaaauccucuuguguuacaugcacccuucucucccuuagggcguacauaccagccucaguacacacucccuucacuucugcaccgcuagcgcccggcaucaauuccgcgauuuuccucaaauugaucccucuggucaaauucauuuuccucgagugaauuuucaggauguccaaucgggcuuccucguucgguggcgggaacucgauuuuccugucgauucugccgggccuc

SEQ ID NO: 1736 - RNA, 248 nt, artificial sequence
  synthetic construct
gguguuuauaacucucgguucuaaaucuaacaacacagcucuuggaauguaauguucgucaucggcuugguagaaaaacacaucuuuacggucgauacuuucgguggcgaaaucuuccaguauuccuucgggauuuaugccauguucggcgcacaaucguuuccaaaacucaaaaccaauuugauuaccgcauuggccgaguuggagaguuaucauuucacaaggcaugguuucgauuaauuuuucac

SEQ ID NO: 1737 - RNA, 251 nt, artificial sequence
  synthetic construct
gaaccaauuuuuuaggaaaucuaucggagaguuucucaaggauguucgaacccauuccggagccuguaccaccggcgaucgaauggcacagaacgaaaccuuccaaacugucgcuaccuucugcuucucugucgaugauaucgaagauuucuucguugagccuuucgccuugggaaaaacccgacgcccaguuguuaccugcaccaccaccauucuucgauagaaauacauuuucuugauuguacagcuuc

SEQ ID NO: 1738 - RNA, 250 nt, artificial sequence
  synthetic construct
guuguucauguacgaaggauaucucaauguuguuguagaaaccgacauaaucguacugaccaaacuguugauuugaguaaacgugggauucuguauuuucaaacgauccgccgcaauucuauuuaaugcuguguuauccagaaccaccacggaauccgccgauuugguuaaucucuucaggguaagcagcgaguuguauggcuguacaaccacaucgcuuauuucauccaaauugggaaauacacuguac

SEQ ID NO: 1739 - RNA, 254 nt, artificial sequence
  synthetic construct
gauuuaugcacuugaguagcauccaccucucccugaaugauguugaguauagaaaugaagcaaugcugggagcuucuguccugugcuguggacaccaucauguucuucgguugcaacagccgccucauaacgucuaaaacagugguuuuccugacgcuggccucgucuguaucggucgacaggggaguguagccagucaucaagaaaugcaaacgaggcguuggaaucaaaggucccagcagcuccaucaaauc

SEQ ID NO: 1740 - RNA, 255 nt, artificial sequence
  synthetic construct
uagagcccuaucaaacagagaacuuauauuaguaugauuagccaacauaagaccugagacucggugagcggacugaauguaaggagacuuccucgauagagccaccuguauacuagccgggccccaagggaugaacugggcgaguuugcguucacguauccuuugcaacgauuuaugcacuugaguagcauccaccucucccugaaugauguugaguauagaaaugaagcaaugcugggagcuucuguccugugc

SEQ ID NO: 1741 - RNA, 252 nt, artificial sequence
  synthetic construct
gcgacccucgccgcuucguccuuugcaucgguaagcgagguauuuuuuggcgucaggucaucuucaaccuccuccguugaaguaucuaauauugauguaucagcuauuucuucaucuaauucguucucuaaggcuucuuuuaaacguuuaacgaguauagguuuggugccuuucgcaucaagcccucgagccgaaaguucauuccguaaaucuacuaccuucaguuuagccggaucuaucuuggaacucauc

SEQ ID NO: 1742 - RNA, 252 nt, artificial sequence
  synthetic construct
gcgucauugucuucuauuguaggcgccucggaggacucgacuggggcaucuugcuuuucgggcgauuucaccaaaggcuuggauuccucagguacaggcguaggcuuaacuucagguacuggcaccucggcuggugcaggcgucgauucgauuucaggcaccgguguagguucuaguguugccacagguucgucgguuuuuucggauucaccuucgucggguacguccuguuccggagaaggggcgcuuccc

SEQ ID NO: 1743 - RNA, 253 nt, artificial sequence
  synthetic construct
gucuucuuugauggggguccucugucgcuugugcgaucgaucgggcgaaucgcuguuucucuugcguuuuucgccuuucuguuggucaucggcguccuuuucguccgccgucuucgaggcaucguccugagcguccauuuuaucuuccuguucuccguuuucuuguucugaugcagcuucuucaguugguucugaauuggcuuccauagaagcgggaagauuuucggguuuauucgaagccucuugcucuucc

SEQ ID NO: 1744 - RNA, 252 nt, artificial sequence
  synthetic construct
gucccuguaccuguugucucgaugauccgguuguuguugccaaucgucccauuuuaauuucuccguuauuuucauuucguagcagaccuuucccguugaaauuccgugcguagcucuagcuccggcccauacguauccaaaugcaccgucguucauuggcuucgcggauaaaaaugauguuuuaucuacuugcaaguauagaucugaaucguaccagcugagcuguacagccucggcguuuauuucgggcuc

SEQ ID NO: 1745 - RNA, 257 nt, artificial sequence
  synthetic construct
gucuuuuucuucugguuugucaucaucuuucuuuucgacagcuucacuuucguuagucuccaucgguucgacugcuucggcuucgguuugguccuucucgucuuucucgcauggaauuucuucgucuuuauucucacucgcguuaucagucucuuuggggucuucuuuaggauccucuuuagguuucucuggaucguuuuugacguuaucgguguuucucuuaucgucucugucguaauaaucucgucugcuucguc

SEQ ID NO: 1746 - RNA, 258 nt, artificial sequence
  synthetic construct
guaaucggagaacuccuuguuuuuaacgauuuuuccagaggaaucguaaccguacgauuuaucaucuucucccaguuguaaugaaguccaagcggcugaccaacccagucugauaaaaugagucgguauaggaacgaauucuucuuccggaguuuccuccuuuuuguccucuuucucguucuuaucguccuguucuguuuuauuaucuuguucauucuuaucgucuuguucguucuuaucguccguuucauucugauc

SEQ ID NO: 1747 - RNA, 252 nt, artificial sequence
  synthetic construct
gcuuaugaauguguaaucggacaguuccgaagguacggcgcaccacgguucguccuguucgccgaaauucaauucuaaggcguaguuucuggauagaacgugagggaacaaggcgagaucuucggguaaaucgucccuggguauuucgauagucgguugaauuuguccauucacggugaauugaagcguuauugacgagucguugauguccaaaaauguaccaauuacgucuccaacaucgaacguuauacc

SEQ ID NO: 1748 - RNA, 267 nt, artificial sequence
  synthetic construct
gaauacuaaucuauucaaaauuuucgagauccuguccacuagagugcuccauuuacccuugaacuucgacuucaucgguucuccaaauacagucauucuaucgaacaaauuggagacacccaguacaguguaauguuuauccacaucagcagcaaugugauucuugacccacucgcuuuuuccugaagcugguagaccgcacaucauaagcaccucacaaucugaucugguuucgggucucguuggaccggcuacuuuauccucaac

SEQ ID NO: 1749 - RNA, 250 nt, artificial sequence
  synthetic construct
gauccuuccauccgccgccgccgccaccgccgccgccgccuugucucgauugaacccacggggacgggccguauuggcgguuguagccgccgcuucucggucuuugauaguuccuucccgagcgguaguuauuucuuuuauucugauuccaccagucucucuuguaucucuuuucguguccguauccggccgauugacccucugcguuguaauccuugaugauuuucuuggccuuuuccucgucuacgcc

SEQ ID NO: 1750 - RNA, 251 nt, artificial sequence
  synthetic construct
gccgcuccaauugcccugaccgccgccguugccgcccugauuauuccaauucugccugccguagcucuguugauuccaaccgccuccccaaccgccgccgccgccguugccgccccaacgcuggccgccgccgcccugggaucuguugcucgauugauagcgaccgccgccgccgccgccuccguagccggauugcgaauaguaaucccuaucucuucgguuguaaucguuaccucuccauucgcgcguuc

SEQ ID NO: 1751 - RNA, 252 nt, artificial sequence
  synthetic construct
uuacuucuguccgcuccaauguuguugcuguugcccguaauaacuccagcugcuguaccccgagccggacgaaccguacuugccgccgcuccaauugcccugaccgccgccguugccgcccugauuauuccaauucugccugccguagcucuguugauuccaaccgccuccccaaccgccgccgccgccguugccgccccaacgcuggccgccgccgcccugggaucuguugcucgauugauagcgaccgcc

SEQ ID NO: 1752 - RNA, 244 nt, artificial sequence
  synthetic construct
gcucgauagucgacuugacacaguggauuuaaaauagcccugcaguuguuucuugugcacaauacaggaucauauugaaugggaggaagaucuacucuuucuuugagaggcugauacagacaggcuaaugguaccaccaagcgaguggcuucgauccuacuggaaggccacacguuccacguaaaacggauaccaucucgguccucauuuugcuggauauauuccucguaaguagucaucuuuc

SEQ ID NO: 1753 - RNA, 249 nt, artificial sequence
  synthetic construct
ggccaaucaaagcguuuugagguaacaaacucaacgacauuugcaaggaguccuucagcgaacucaauucuuccucauccaugcaaguauccacaacauacaagaauaugggaggcagacauugaacucuguuaaucguguacucgagagucgagaacauaggcauuaauucagcagguugauguuguucggagauagcugcauauuguugaggaaauggauuucuuuggaagcagaaguugcaaaccc

SEQ ID NO: 1754 - RNA, 254 nt, artificial sequence
  synthetic construct
gauucauaucacauuuagaaauagguugcaggaaucugcuaccaggcgggacaggugcagauugagguuguccaggucucauagguugccccgguuguugagguuguuguuguugagucauugcgacuuuaccgauacccaacauuuccugaacuuguuuagccguaagaucuuuagugccucggaacacguaagauuugcugacaccuucggugccuaauucgugaacuugaaccauuuuuccaaauguaauc

SEQ ID NO: 1755 - RNA, 259 nt, artificial sequence
  synthetic construct
ggcuuuuuucauauauuuugcauuauccuuuuguauaucaugaugggaccuaauagguuguuucaaaucgucguucaaaacuugaccuggaccuugugaacaagagccaccaacaaaaagcauaacccuagccccuguauuugcauaagugcacuccaauagaccgauagcaaucgauaaugcaacaccagugcaucuuaguggccuuuuaccuugauguacaggccaaggaucuuucuguuguucuccaauuaaaucc

SEQ ID NO: 1756 - RNA, 263 nt, artificial sequence
  synthetic construct
guacuuuuaauucucuggaacauuucacuucuaauguuccguuaaacgccauuuucaauucguuuuucugaucucgagugaacacccuuuggaauguuuguuuaaauagcgaugaauuaaacgagucucccaucaccaugugaccaccuguagaauuagcacauugcuucauuuccauuaaaccgguuugaucgagugcacaggaauaaauaucgaugcagugaccauuagucgcugcucucaucgcuaaaguaucguaaugc

SEQ ID NO: 1757 - RNA, 254 nt, artificial sequence
  synthetic construct
gauauuucaaauuccuccauugagcuauagucuccccguggaauaucaaaauuuggaaaaacguguccauaagcaauauucuaucgggcuguauggaacucguaucuaauaguacaggcucaggggggccguugaaacuguaacuguacaaaauugguugaaucaugaucagugauugaguaaggucuucucucaucaacauaugccgauagaaggauguuucaucaggagaauuauugaaaacuugcaggaac

SEQ ID NO: 1758 - RNA, 279 nt, artificial sequence
  synthetic construct
uuaagccguggacgaaacugccaauuuuuucaaaugauccauaaauacuugaagugauacaucgucuguuagaaccggagcgccggcauccccuccauaugaguacauguuauugugagucugacucggauugacuuuggacaauaaaaaucuagccugggaucccccuuguucggugucgauauaucucggcauggggaaccuuguuuguaauaucucuugugcaucaucaauaggagcuugcaacaauugccuaaaguucucguauucgggcauguc

SEQ ID NO: 1759 - RNA, 254 nt, artificial sequence
  synthetic construct
gaagaaaacaucuguggcuucuuucacguuuaaagcuucacccugguuuaguagguaaagcaauuuggugagaauuagggugcauuuucuuggauuaacggauguuucguuaaacacucgagcuucuugcaaaacagucguuuuuucgauguuuugaaauauauuuccaacuccaucuucuuccuccuuuuugucucucuuaaaagagcucauuuuuauaggauauauuuugaaaauuggaauauuuuuuacac

SEQ ID NO: 1760 - RNA, 252 nt, artificial sequence
  synthetic construct
gacagcggaauuucuaucgacgauugccugcuucauguaucguucgauggcuugcagcaugguagcaucggugaugcugcacaaggcacguauagcagcugcucuguaaaugucuucuuugcccgucauaucuuuggugaggcucgaaguaacuaugauuacaucaucugcggucgagcugaguucuuugauuccuagauacaccauucuucgaaggacuacaucuuucgauuggaacaguuuggucaucgc

SEQ ID NO: 1761 - RNA, 254 nt, artificial sequence
  synthetic construct
gaggagcuuagcuauuauucugauaagcauacaaacagcguauggagauuuuaagguaguucuaguuaguuuagcuauuaguuucguaacagccaaccuaucugauuuucugaugugauacaggagccccaaggcaugauauugcaccaucacauuaucgcuguuaauagcuuccugugcuucguucacccaucuuuuaaccaccucaggagccauuuuggucaugugcaaagaacugaccaaggcagcugaac

SEQ ID NO: 1762 - RNA, 251 nt, artificial sequence
  synthetic construct
gccgugacggcggccggaugggaaauggccacuugguuuagaguucuaacggcggcgaaucucaaaguggccuucggugaaccgcagaacaauuguaauacacucacagccggcgccaguuccuugcuagugguacguuugagauugacgaucgcgugggcugccucguaaacaaccaucucagauuugugccucaaacaagauucgaugaaaucgaaguagggaaaaucguugccggaaucuucuucuuc

SEQ ID NO: 1763 - RNA, 254 nt, artificial sequence
  synthetic construct
gccuucaucucuuagcauggccgauaaaaaguucaugagaguguugugcuuucgagggaauuuaagagccagcgcucugaucgcuuggacuaccacgacuuugaauucaucgcugauuucagauacgaaacuagcuauuuguuucauaagacgaucaacugacgauucagcaccaguuuuuaauaaaguagugauagcaagcguggcgaucgaucgauuggaaucgguaaucaaauucuccaaaucuaaauuac

SEQ ID NO: 1764 - RNA, 251 nt, artificial sequence
  synthetic construct
gaaacagcggcugcucuuauagaagggcacucuaagaugacgcgguuguaaaugaaacggauauaucuggaagguuguuugguuuucgguccuucucuaccaagcagaugcaauauucuaacagcuaaagaaacguguucgcaaucuucgauaaacucgcacagaugagccagacccgauucuuuagcuucaggauuauccucgauaauggugauuaugguguccgcaauggaagcuuuguauuccaaacc

SEQ ID NO: 1765 - RNA, 254 nt, artificial sequence
  synthetic construct
gauuuuauaucgaacgguugauucguagaguucugcguguacuccuucaacgagcguucuaacccugguauagauaccuguaaaguaucaaggauaaaguuguuguacaaguuuuuaucguuuuugcuaaguaugcugcuguaauaaguggcucugucucugacuucaucguccgaguccauuuggcaucuggcuaguaauacuugaauauuuucuaacaaaucgggacacgaagcuccgaauugggccauggc

SEQ ID NO: 1766 - RNA, 250 nt, artificial sequence
  synthetic construct
gggugcucuugccuucaggaacuuuaucaguucuuucagccgguugcaauccaaggaacugcacgauauuuuucacagcuucguccaacguauucauugaacuuagagaauauguauccuccuuuucuacggaacucucagcagccguuucccaugcagcgccccaauuaacuuugcucacucucuguauuugaucgcccaacguuauuuccaaaucuucgaguauguauucaucauuauauccuucuuc

SEQ ID NO: 1767 - RNA, 250 nt, artificial sequence
  synthetic construct
uuaccaaaauaucgauuccaccucuaaagacuccugauaauaaaagggugugggugcucuugccaaaauaucgauaccaccucuaaagacuccgggugcucuugccuucaggaacuuuaucaguucuuucagccgguugcaauccaaggaacugcacgauauuuuucacagcuucguccaacguauucauugaacuuagagaauauguauccuccuuuucuacggaacucucagcagccguuucccaugc

SEQ ID NO: 1768 - RNA, 247 nt, artificial sequence
  synthetic construct
gcuuuugcuuugcuaauaagacucagaaauggucugguagccuuuaucagcucggcuaguucuuuagccuugcccuccuuuuuguacuucucgcccaaguugaggauguccugcucuuuauuaacaauauucuccucgucaucuucgucugccggauuuaauuuuaacaacuugucauguugagaaggaacggacugagcucuuucgaauaacauugcaccagccauauuucuuacuucuucacugc

SEQ ID NO: 1769 - RNA, 246 nt, artificial sequence
  synthetic construct
gaccagcagauuuuugucguccaguuucuucagcucuuuuaacaggguggauuccaguuguagggcaucgguguacauuccgguaucgaaauacagggcgaucaggcgcgcuuccagcgauuggcgcaaaaacguucuucucuccucuuucgcccauucuauacauucuuuacacaguuguaccucaaugccgauaccugccuccaaguccaaaaaguaaucaaccagugaucuaacuaauuuugc

SEQ ID NO: 1770 - RNA, 250 nt, artificial sequence
  synthetic construct
gagcagucagagcuuugggagauucgacgcuaucgaacccuucgaaggcuucguaaaaauaggaguaagcugucuugaaauccuuuucgucggcugcgugcagcacgcccgauugcagaucgagggcggccugcaucuucggagggcaauaaauagcguuagcggucguucuagcggacguuagagcggcucgagcuuuggguaaauugcugagagcgugauauguuuugcuuucgagcaguugcacuuc

SEQ ID NO: 1771 - RNA, 253 nt, artificial sequence
  synthetic construct
gcacaaauuuuguucuaacauauugucguagaggguuccuaaaugugcucguacgauaacgucaucuuccagcucauguuugaauuguuuuacggcaaguugaaaaucugcaagagaucuuuuaugggcugcuugugcgacugcuuucauggccucgauaucuuuaccugcauacuuuauggcuaauuuuccacucacaauuugcuguacgucuucgggacuauuaaucauaauuuuggacagaagcauguac

SEQ ID NO: 1772 - RNA, 260 nt, artificial sequence
  synthetic construct
cuaugacaacuuuuucgcuuuuugauagagagugucuacgacuuuacucauacucuggaugguuucgagagccauuucauagguuuugucuaccggaguuucuucaaacacuaucaggacaccaucacccuggucuaaaauuccaugaaacuuggcaucuaaaaucaucugcgauaguuucuucucuacuuguaaaacaggaagcuuaaucguuuuugcuauauauucuacuuggacacgcgaguaagguucaaugauuc

SEQ ID NO: 1773 - RNA, 246 nt, artificial sequence
  synthetic construct
guuggugaugauaccguguucgaugggguauuucaaagugaggauaccucuuuugcuuugggccucgucuccuacguacgaguccuuuugucccauaccgaccaucacacccugaugucuugggcgaccgacgaucgaggggaagacggcgcgcggggcgucgucuccggcgaaaccagccuugcacauaccggauccauugucaacgacaagagccgcaacaucgucgucacacauguugucuuc

SEQ ID NO: 1774 - RNA, 250 nt, artificial sequence
  synthetic construct
ggccgucggguaguucguagcucuucuccaaagagcucgagcuggccgccguggccauuuccuguucaaaguccaacgcuacguagcagagcuucucuuugaugucacguacgauuucucuuucggcugucguggugaaagaguauccacguucagucaaaaucuucaugagguagucggucaaaucucugccggccaaguccaaacgcaggauggcgugaggaagggcguaaccuucguagauggguac

SEQ ID NO: 1775 - RNA, 250 nt, artificial sequence
  synthetic construct
gaugaucuugaucuugaucgugcugggggcaagagcggugauuuccuuuugcauacggucagcaauaccaggguacauggugguaccaccggagaguacgguguuggcguacuuagaagcacuugcggugaacgauuccagggccggauucgucguauuccuguuuggagauccacaucuguuggaaaguggaaagagaagccaagauggauccaccgauccauacggaguauuuccuuucugggggagc

SEQ ID NO: 1776 - RNA, 252 nt, artificial sequence
  synthetic construct
gaugagccaagcauuuucgguugcuuucagagacucuaauacaggaugggccagaagcucuccgagauuguaaaccccuucgcccagcaaagcugcuaaacccaagaaaaaugcaugcugcacuuucaccucggucuucaaggauuccacaucuaugcagcccaaauaccucaaagcagugcgauaauauugagcauggucuccuugaauucuguaguauugagaggcgaguagauaaaaucucccgugcac

SEQ ID NO: 1777 - RNA, 247 nt, artificial sequence
  synthetic construct
gugaaagcgccuucauuaccagcaguucaauuucguuuagagguaaccucguuucuuuugaaauuuccgcaaauguuaauugucuguugugggacggucuauuaaaugucaucuccaucaaacauaguaaggauaucuucugucuuaagaauaguuccucgguggccaaaucggcuauagaagaccacugaguuuucauggcuucaaacuuccuaauguuccccgaauugaaggcguacaagagcuc

SEQ ID NO: 1778 - RNA, 244 nt, artificial sequence
  synthetic construct
guacauguuuuccaaguagucgugguccaagaaccauacagauuuaucuuugucguccucaucaaaagggacugcaaaacuguuagacacauccaagacuccuuuagcccuccagcaaccgaguagaacaccgacaacgcgcuuuugauugccgauuuuccccauucgauugaaaugguccacuacgcugaggagcaccagcgggugcacuauuaccuuagucguuguuaccucuguacucggc

SEQ ID NO: 1779 - RNA, 252 nt, artificial sequence
  synthetic construct
gccuauuucgcucgggacguguucaaauguuuuggacguaggggagccaucaucguggacuucuucgaccgcuugguacgcuucaguaggaagccccagaucuuuagguuucgcaucgauaaucaccagcacggaauuggggcaguaucuucgaauuaauucguuaauagcgaugucauuuuggugcaauuuaggaccagugugguaccaaccaacgacgcguucucuagcguugacuuucuuaaacaugcc

SEQ ID NO: 1780 - RNA, 254 nt, artificial sequence
  synthetic construct
gaauuguugaaugcaucuugguuuauaucgggcaacaaauugaaaaugucuugcaauugauagaugaucugaugauuaaugggcaguuugguaucgcccacuugcaucaaauagucucuuaugucucucaauugcaaaugcaacccuuucaggccuaauaacugauuggugauccucugagauaaagugcccacuguagugucuuugauaucucuuaauaaauguucuacgccgacuuccucggcuucuucugc

SEQ ID NO: 1781 - RNA, 245 nt, artificial sequence
  synthetic construct
gggaucaccgacaguuacgccggagguuuccucguauaccugaauaguugccauaucaccuuccaaacggaugauuucuccuacuaauucgaaguaaccuacucgaaccaauucguacauagcagaaccggacauuuuuucggcggugacgacuggaccagauacggcauggacauacccauacugucccucuuuuuccucaucuccaacgcguacuuucgacauuuugguggauguuauguuuc

SEQ ID NO: 1782 - RNA, 246 nt, artificial sequence
  synthetic construct
gaggguguuuucgugaacuauaccguagaugucgccuccgguuaagugagagcccaucuugauguuaauggguuggaagucccauuuggccguucuggacagugccgguacguugauaccuuucgggauguagaugcucuccguuagaacguugaugucuuucaauggacguuggauaccgucgaaaauggagcccauuauaccggggccaaguuccaccgauaaggguuugccggaucucaauac

SEQ ID NO: 1783 - RNA, 246 nt, artificial sequence
  synthetic construct
gccuuguacgcaagggaaaagagaauccaauacacguugaccggugaguagcgggugauuggccggcaauuuuucgcugaccggucuggcuugacggacuggccacacuugcaacauggugaauuuggaucguucaccgucgaacuccguuuccaguacaacuucaucuacuguguaauuacccgguucagcaauguacguaacgguaccuuuagcuuuaggcgguagaagcauuuugugcuugac

SEQ ID NO: 1784 - RNA, 257 nt, artificial sequence
  synthetic construct
guauagauggaggccucacgggcggcgacgggcauguuggagguguuggccaccagggcgguacgcuucauaauggacucggugugaccgucgauuuccacgcucagcucggggaagucucgcaacaccucggacauuucguugccucuuucuccgcaacccacguagaugaugacgucggaguuggaguauuuggauagcgauugggaaaugacgguuuugccgcaaccgaaggcaccgggaauggcuguaguacc

SEQ ID NO: 1785 - RNA, 248 nt, artificial sequence
  synthetic construct
ggcgacacggcuccgacgaucgacacggaacccucccuaucgggguuacccaagcacuuaacgcgaccggcgcgcucguagaacgaggccaaccuggcccccaaguaggccggguaaccggaaucggcgggcaucucggccaaacgaccagagauuucucucaaggccucggcccaacgggacgucgaaucggccaucaucgacacgugguaacccaugucucugaaguacucggacaacgugaugcc

SEQ ID NO: 1786 - RNA, 248 nt, artificial sequence
  synthetic construct
gcugcacgauuuccguaagaucaucuucuucuugaagaauuucuuuaacuuugguucuuagcgguauaaauucagggaaguuuuugucauagaaaucaucuaaggcccucaaguacuucgaguacgaacugagccagucgacagaagggaaaugcuuacguugugcaagcuucuuguccaauccccaaaacaccuggacaauaccaagaguagcagaagugacgggaucggagaaaucaccaccaggc

SEQ ID NO: 1787 - RNA, 254 nt, artificial sequence
  synthetic construct
gguacaaaauguugcucaucgaaucccugaucaccguccacgugauuuuguuuucggauugagcggucgauuccaccgcgugucucgccauaucguacaugccgaucauguucuucaacaugcccaccguuuuguagaacggacagaaucuaucguacgacgaguacgaguucuguugcaggaaaucuuccuucagcaacuuggcgauuuccaauguuauuuuaucggcuuccgccaacgaggccuuuccuacc

SEQ ID NO: 1788 - RNA, 252 nt, artificial sequence
  synthetic construct
uuaauccucuagauuucugaacgccugcuggauguccucguacaauuggucgaaauccgccuugauuuucgccucgccgucuuugacgggauccuugaauuucauacugcucgguacaaaauguugcucaucgaaucccugaucaccguccacgugauuuuguuuucggauugagcggucgauuccaccgcgugucucgccauaucguacaugccgaucauguucuucaacaugcccaccguuuuguagaac

SEQ ID NO: 1789 - RNA, 247 nt, artificial sequence
  synthetic construct
ggcuuuuaauucuugcagggugaauccgcguccggcgcguauuuuggugugguaccugacugugggacagcgcacgacgggucucagagggccggcagcuggucugggggcgacagcacgggcuuucuugauucgguucugccuccugcggauuuugcgugcagguugguugaaccaggucuucacgaaucuuugccaauccuuguggaaauggccauucggaaucauauuauuaccuuuuggagcc

SEQ ID NO: 1790 - RNA, 247 nt, artificial sequence
  synthetic construct
ccuugcaauuggguggcuacuuuacguucuucuucgguagcuucgccagcucgcagcuucuucuuguuguggauggggaacaggaucaacuuggauuuguauucuuucaaacguugagcguuuaguugaauggauucuacggacuuguuccuccuccuguggucgacggcgacgccgacgguccuggcgaaucucggguuaagucccgcggcuuuuaauucuugcagggugaauccgcguccggcgc

SEQ ID NO: 1791 - RNA, 249 nt, artificial sequence
  synthetic construct
ggcuacauccugugcagcuaacauagcggcguagggagaggccucgucccugucggcuuugacuuucaugccuccggugacucuggagaugguuucucugcccgauaaaucggugacauguacgaaugugucguugaaacuggcgaaaaugugggcaacgccgaagacuaucucgccuucgcguacuugcgguccaagggacaguuggaccuccucuuugggcguuuuuccuuuccucggggccauguc

SEQ ID NO: 1792 - RNA, 253 nt, artificial sequence
  synthetic construct
cuacaaccugcgaccgcgacgaccucccuuccuacggcaacaauccgagggaaucggaguaacaucuucgauucugccuauuuucauguuggaucgagccagggcucucaaagcgcuuugggcccccgguccaggggucuucguuuuguugccgccgguggcgcgcaauuugaugugcagggccgugauuccuagcguuuugcauuuuucggcuacauccugugcagcuaacauagcggcguagggagaggcc

SEQ ID NO: 1793 - RNA, 256 nt, artificial sequence
  synthetic construct
gauuuucuccauaucgucccaguuggugacgauuccguguucaaugggguacuucagagugaggauaccucgcuugcuuugggccucgucucccacguaggaguccuucuggcccaugccuaccaugacgcccuggugucuggggcgccccacgaucgaggggaacacggcccgaggggcgucguccccggcgaaaccggccuugcacauaccggagccauugucuacgacuaaagcggcgacuucuucuucacac

SEQ ID NO: 1794 - RNA, 251 nt, artificial sequence
  synthetic construct
guaacccucguagaugggcacggugugcgacacaccgucuccggaguccaauacgauaccggugguacgaccggaggcguacagagagaguacggccuggauggccacguacauagcgggcguguugaagguuucgaacauaauuugcgucaucuucucccuguuggcuuucggguugagcggagcuuccgucaacaguacgggguguucuucgggggccacgcgaagcucguuguagaaggugugaugcc

SEQ ID NO: 1795 - RNA, 249 nt, artificial sequence
  synthetic construct
guuaccgauggugaucaccuggccgucggguaauucguagcucuucuccaaagagcucgagcuggccgcgguggccaucuccuguucgaaguccaacgccacguagcagagcuucucuuugaugucacguacgauuucucuuucggcugucguggugaaagaguauccacguucggucaggaucuucaugagguagucggucaagucucugccggccaaauccaaacgcaggauggcguggggcagagc

SEQ ID NO: 1796 - RNA, 238 nt, artificial sequence
  synthetic construct
ggcguacaaguccuuacggauguccacgucgcacuucaugaucgaguuguaggugguuucguggauaccggcagccuccauacccaagaacgaaggcuggaagagagccuccggacaacggaaucucucguuaccgauggugaucaccuggccgucggguaauucguagcucuucuccaaagagcucgagcuggccgcgguggccaucuccuguucgaaguccaacgccacguagcag

SEQ ID NO: 1797 - RNA, 257 nt, artificial sequence
  synthetic construct
ggaucucaguaccggaucgccuacgguuacuccggagguuucuucguauaccugaauaguugccauaucaccuuccaaacggaugauuucuccuacuaauucgaaguagccuacgcguaccaauucguacauagcagaaccggacaucuuuucggcggugacgacuggaccagauacggcauggacauacccguacugucccucuuuuuccucaucuccuacucguacuuucgacauguuuguggauguuauguuuc

SEQ ID NO: 1798 - RNA, 257 nt, artificial sequence
  synthetic construct
gguagaagcauuuugugcuuuacgagaguguuuucguggacuauaccguagaugucgccuccgguuaagugagagcccaucuugauguugauggguuggaaaucccauuuggccguucuggauagagccgguacguugauaccuuuggggauguagaugcucuccguuagcacguugaugucuuucaagggacguuggauaccgucgaaaaucgaacccaugauacccggaccaaguuccacggauaaagguuugcc

SEQ ID NO: 1799 - RNA, 256 nt, artificial sequence
  synthetic construct
gcaaccgaaggcgccgggaauggcugucguaccgccuuguacgcaagggaaaagagaauccaauacacguugaccgguaagcagagggugauuggccgguaauuucucgcugaccggucuggcuugacggacuggccauacuuguaacauggugaauuuggaucguucaccaucgaauucugucucaaguacuacuucaucuacuguguaauugccugguucagcaauguacguaacgguaccuuuagcuuuaggc

SEQ ID NO: 1800 - RNA, 255 nt, artificial sequence
  synthetic construct
gucucugaaguacucggauagcgugauacccguauagauggaggccucacgggcggccacgggcauguuggagguguuggccaccagugcgguacgcuucaugauggauucgguguggccgucgauuuccacgcucagcucggggaagucccgcaacacuucggacauuucguugccucucucgccgcaacccacguagaugaugacgucggaguuggaguauuuggacagcgauugggagaugacgguuuugcc

SEQ ID NO: 1801 - RNA, 249 nt, artificial sequence
  synthetic construct
gaagugacaggaucagagaaaucaccaccaggcggcgacacggcuccuacaaucgaaacagacccuucccuaucgggguuacccaagcacuuaacgcgaccggcgcgcucguagaaagaggccaaucgggcccccaaguaggccggguaaccggaaucggcgggcaucucggccaaacgaccggaaauuucucucaacgccucggcccaacgggacguggaaucggccaucaucgauacgugguaaccc

SEQ ID NO: 1802 - RNA, 254 nt, artificial sequence
  synthetic construct
guaaucuuaucagcuucagcuaaugaagcuuuuccuaccagcugcacgauuuccguaaggucgucuucuucuugaaggauuucuuuaacuuugguucuuagcgguauaaauucagggaaguuuuugucauagaaaucauccaaagcccucaaauauuuagaguaugaacucagccagucgacagacgggaagugcuuacguugggcaagcuucuuguccaauccccaaaacacuugaacgauaccaagaguagc

SEQ ID NO: 1803 - RNA, 253 nt, artificial sequence
  synthetic construct
gccaucuuucaccggauccuugaacuucauacugcucaauugguacaaaauguugcucaucgaaucccugaucaccguccacgugaucuuguucucagauugagcagucgacuccacggcgugucucgccauaucguacaucccaaucauguucuucaacauacccacgguuuuguagaagggacagaaucuaucguacgaugaguacgaguucuguugcaggaaaucuucuuucaacagcuuggcgauuucc

SEQ ID NO: 1804 - RNA, 242 nt, artificial sequence
  synthetic construct
guuaauccuccagauuucugaacgccugcuggauauccucguacaacugaucgaaauccgccuugaucuucgccucgccaucuuucaccggauccuugaacuucauacugcucaauugguacaaaauguugcucaucgaaucccugaucaccguccacgugaucuuguucucagauugagcagucgacuccacggcgugucucgccauaucguacaucccaaucauguucuucaacauaccc

SEQ ID NO: 1805 - RNA, 255 nt, artificial sequence
  synthetic construct
gaguaaggagaauuuaauauaguguuuauaacucucgguucuaaauccaacaaaacagcucuaggaauguaauguucgucaucggcuugguagaaaaacacaucuuugcgaucaauacuuucgguggcgaaaucuuccaguauucccucgggauuuaugccgugcucggcgcacaaucgcuuccaaaacucgaaaccaauuugauugccgcauuggccgaguuggagaguuaucauuucgcaaggcauggucacc

SEQ ID NO: 1806 - RNA, 255 nt, artificial sequence
  synthetic construct
guuugaacuaauuuuuucgggaaccuuucggagaguuuuucuaggauguuggaacccauuccggagccaguaccaccagcgaucgaauggcacaaaacgaagcccuccaaacugucgcuacccuccgcuucucuaucgaugauaucgaauauuucuucguucagucuuucccccugggaaaaacccgaagcccaguuguuaccugcaccaccaccauuuuucgauagaaauacguuuucuugauuguacagcuuc

SEQ ID NO: 1807 - RNA, 250 nt, artificial sequence
  synthetic construct
guuguucauauacgaaggauaucuuaguguuguuguagaaaccgacauaaucguacugaccaagcuguugauuuggguaaacgugggauucuguaucuucaaacgaucggccgcgauucuauuuaaagcuguguuauccaaaaccaccacagagucugcugauuugguuaaucucuucagggugaguagcgaguuguagggcugcacaacgacaucacuuauuucauccaaauuggggaauacacuguac

SEQ ID NO: 1808 - RNA, 255 nt, artificial sequence
  synthetic construct
ggauuuaugcacuugaguaggaucuacuucacccuggaugauguugaguauagaaaugaagcaaugcugcgaguuucugucuagugcugucgacaccaucauauucuucgguugcaacagccgccucaugacgucuaaaaccgugguuuuccugacgcuggccucgucaguaucggucgauagaggaguguagccagucauuaggaaaugcaaacgaggcguugggauuagaggucccagcaacuccauuaaauc

SEQ ID NO: 1809 - RNA, 258 nt, artificial sequence
  synthetic construct
gaauccaauucaucuaaauuaucuuuaaacauaucuuccuuuuuaaauugauccaaaaacgccucccucuuucucagcuuaucguauugugucagggcccuaucgaacagagaacuuauauuaguaugauuagccaacauaagcccagagacucgaugagcagacugaauguauggggauuucuucgauagugcaacuuguauacuagcggguccccauggaaugaacugggcuagcuugcguucgcguauccuuugc

SEQ ID NO: 1810 - RNA, 259 nt, artificial sequence
  synthetic construct
ggcuucaaaucgcuaauaucauucgaauuguuaucccacauacaauaauccucuuuaguagccgccacauauucaucaaccaaauccugaaccaccucucuacucgaauccaauucaucuaaauuaucuuuaaacauaucuuccuuuuuaaauugauccaaaaacgccucccucuuucucagcuuaucguauugugucagggcccuaucgaacagagaacuuauauuaguaugauuagccaacauaagcccagagacuc

SEQ ID NO: 1811 - RNA, 258 nt, artificial sequence
  synthetic construct
gcacuucucagcuacauccugugcagcuaacauagcggcguagggagaagccucgucucugucagcuuugacuuucaugccuccaguaacucuggaaauaguuucccugcccgauaaaucggugacauguacgaauguaucauugaaacuagcgaaaaugugugcaacaccgaagacaauuucgccuucgcguacuugcgguccaagggacaauuggaccuccucuuuggguguuuuuccuuuccucggagccauuuc

SEQ ID NO: 1812 - RNA, 259 nt, artificial sequence
  synthetic construct
gcgaccacgacgaccucccuuccuacggcaacaaucugacggaauuggaguaacaucuucgauucugccuauuuucauguuggaucuagccagagcccucaaugcgcuuugugcucccggucccggugucuuuguuuuguuaccaccuguagcacgcaauuugauguggagagcugugauuccgcacuucucagcuacauccugugcagcuaacauagcggcguagggagaagccucgucucugucagcuuugacuuuc

SEQ ID NO: 1813 - RNA, 259 nt, artificial sequence
  synthetic construct
gcaaggucuccagaucuucuaauauguuacucgcccuaguggugaugagcagcauguacaguuucucuaaaggcugguacacguagcguacagagucgguuucaacgaaaguaugcugggugccagucgggauuaacuucgggaaagccgccagcaggccuucgaugcgggcuuuggucauuucgacgaacugucgagacacgaucguuuugccugcuuucgugcaaacugcugccgcaauuaguaccauugugaauuc

SEQ ID NO: 1814 - RNA, 255 nt, artificial sequence
  synthetic construct
gccuuugcaauucuuuagcuuuuucucucaucuuauucuucgcuucacgcucuugagucugucugacagcuugguauacuuuuuccucgugcgaauccauuuccacgaacgugcgaauuugagacagauucacgcucucucuauaaccuaaagcuacgauuucaucgaaagcgaauaucagagaaaaggcguuuucugcuauuucgcucucaucuaaaguccuacaguauuccgggaucacucgagcaaacaacc

SEQ ID NO: 1815 - RNA, 249 nt, artificial sequence
  synthetic construct
gggacaaugacguuuucaccuucggauuucaguugaucgacgaaggauuccacgucucugguuuuuccuccuaauuucauuccacgcgguuucuggguagcagaugguguguaugaaggagguuugacaucguuugucggaauagcgauauccccaauggauggugucggaguguaagucguagagcuaccgaagccuccgcuguuuccaaacauagccuugccgccuuucuuuugcgcuuccauuuuc

SEQ ID NO: 1816 - RNA, 260 nt, artificial sequence
  synthetic construct
gcaauuugaacaguucuuuaucgacauucgggugcguuugaagcugcacuccgugcguauuccuguuaucuaacuucacccuuauucugccccauuucucgucuccuaugugcaagguugccaagccuaauauuucgaacugcugcacgccgccgucgcgacccauucucgcgaucaauuucucuucuaaucucaaaugaacgucaucgauauccguuuugauagcgggggcuuuaguuccgggcugcgagauacuauuc

SEQ ID NO: 1817 - RNA, 254 nt, artificial sequence
  synthetic construct
gcauucacccacuauuggagagcaaccaauuggcaaaggaauuguaauguuaacguccacuaauucuaaguuagugugggcaaguucguauucaauauucacaucgcaacugccgucuccugcuucagaaggccaacaguuuauuagcagaggcaccagggcuucgucaguacuuugcaaucgccauuuuaauacaccuacgucaguguggagcgggaaugguuucgaaggcuguuuuaaaccaauuucugaac

SEQ ID NO: 1818 - RNA, 265 nt, artificial sequence
  synthetic construct
guuacacaacuucauauuuuuccggauaaaguacuguuuccacggaguguuuuauaggagaauagucgucgacgagaacuacuucaguuacuguaauacuagcauaggacgauuuagaaguaaauccaaccgauaaugggaagaaaucauugggaauagcucugggcgcguugaauucuaaagaacccgucuuguugcuagcaucaauuaccggcagguuccauacaagaugauuucuuuuugcuucgugaguguaugaaccauc

SEQ ID NO: 1819 - RNA, 253 nt, artificial sequence
  synthetic construct
gauauuaucaugaagaagaaaccgcagcauaguaggccggaccagauguuguuuuccaaguuaucagugucucugacaaaagcaaaguaaauaagugcagcgauggauaucaacaacaaugauaugguauggggauuauagaaaaacugcaaugaaauaucaucgaccggcuuuucauuuauggugcagaaacugucgugccuuucucgggccauuguaucuuucgaaugggcgcucuucauguugucucugc

SEQ ID NO: 1820 - RNA, 256 nt, artificial sequence
  synthetic construct
gacugcgaagacguccacguggccccauagccucuccauuguuauauccgagcaguucacgccguauuccuuguccaugucgauguggaacucggagagcgauggguccagccauaguaugaugcuuuuaacuguuuuguaguuuuggaauaggauaaacaggcagaacauuagguagaguacgcucaugccgaagaccauucgccagauagccggguggggucggaugaacgguccauuggggaaagccagcauc

SEQ ID NO: 1821 - RNA, 261 nt, artificial sequence
  synthetic construct
ggucgugguguggaucuuuuugauucccacccacguguacucgcgcauuuccagcaucuugcagauuuucaagccgcaccagaugcccaauccguugcacaccaggacgucgaggaucaaagcgucccaccagcacucgaugaaguugggcaggagaugggcgaaggccaguucggugaucucccacaugcagcuuaucgcccacaguaugcccaugugucugaugaguaccgccuugaacauccagcccaagaagugucc

SEQ ID NO: 1822 - RNA, 252 nt, artificial sequence
  synthetic construct
guaacaguaguacugucuuacagauggcgcuacgauuaccccaaugaguaucaaacgaccugacaccaagaaaugggaagcgggcaguucgaauacaugcuucaagaaaaagguguucagcucagacguuugccaaaacaacaccaauuggcacaaggauaugauccgcauguaggagcauugcggaucgagccaucucaccgaaguccagcucuccggcgugaauugcaacauggcccgcuuuaucuuacc

SEQ ID NO: 1823 - RNA, 282 nt, artificial sequence
  synthetic construct
guuuuucuuuucaccuuggccauucugaaaccuaauuuucguuuuacucuuaccaggacucacuuccaacuuuuuggaauaauaucuguuguacaaaacgcauguuaucacaacaccuacagauacuaucaccauuauuagcaaccaaacaaucauguuuauaauuugcguuuguucaaacagcucucuaccgugcuugaugcaaaucaaugccucagcuaccauuaugcacccguacacccagcauuggguacccacucguuugcaggacguaucaguaac

SEQ ID NO: 1824 - RNA, 254 nt, artificial sequence
  synthetic construct
gaagaaaacgucuguugcuucuuuuacguuuaaagcuucccccugauuuaguagguaaaguaauuuggugagaauuagggugcauuuucuuggauucacugauguuucguuaaacacucgagcuucuuguaaaacagugguuuuuucgauauuuugaaauauguuuccaacuccgucuucuuccuccuuuuugucucuuuuaaaagagcucauuuuaaugggauauauuuugaaaauuggaauauuuuuuacac

SEQ ID NO: 1825 - RNA, 252 nt, artificial sequence
  synthetic construct
gacagcggaauuucuaucuacgauugcuugcuucauguaccguucgauggcuuguagcaugguagcaucggugaugcugcauaaagcacguauagcagcugcucuguaaaugucuucuuugccggucauaucuuuggugaggcucgaaguuacuaugauuacaucgucugcggucgagcucagcucuuugaugccuagguacaccauucuucgaaguauuacguccuucgauuggaauaguuuggucauugc

SEQ ID NO: 1826 - RNA, 254 nt, artificial sequence
  synthetic construct
gaggagcuuggcuauuauucugauaagcauacaaacagcauaaggagauuucaggguaguucugguuaguuuagcuauuaauuuuguaacagccaaccuaucuguuuuucugaugugguauaggagccccaaggcgugauauugcaccauuacauuaucacuauuaauagcuuccugugcuucguuuacccaucuuuucaccacuucaggugccauuuuggucaugugcaaagagcugaccaaugcagcugaac

SEQ ID NO: 1827 - RNA, 251 nt, artificial sequence
  synthetic construct
gcugucacagcggcugggugggaaauggccacuugauuuagaguucuuacagcggcgaaucucaaaguagccuucggugaaccgcagaacaauuguaauacacucacagcuggggccaauucuuugcuagucguacguuugagauuaacgauagcaugggcugcuucguaaacuaccaucucagacuugugccuuagacaagauucgaugaaaucgaaguagggaaaaucauuguuggaaucuucuucuuc

SEQ ID NO: 1828 - RNA, 254 nt, artificial sequence
  synthetic construct
gccuucaucucuuaacauagccgauaaaaaguucaugagaguguuaugcuuucgagggaauuuaagagccagagcucugaucgcuugaacuaccacaacuuugaauucaucgcuaauuucagauacgaaacucgcuauuuguuucauaagacgaucaacagacgauucagcaccaguuuuuaauaaaguagugauagcaagaguggcgaucgaucgauuagaaucaguaaucaaguucuccaaaucuaaauuac

SEQ ID NO: 1829 - RNA, 252 nt, artificial sequence
  synthetic construct
gggaaugccaguggugggaucgcaaucuuuaacgauaaacuucaacaccgccccgaaaguaccaacgcaacuaggcaaaucgucgucggggaacuucaaaauagcguaggugugauuggucucguuguaaugcagcugcuugcacggcaccaccgacagcaacucgaacccuucgcucggcuccagcuccacccgcacguccuccagcaauugaucggccagcguguucaggcaaucgaacugcaggaccac

SEQ ID NO: 1830 - RNA, 260 nt, artificial sequence
  synthetic construct
gugugggugcucuugccuucgggcacuuuaucaguucuuucggccgguugcaauccaaggaacugcacgauauuuuucacagcuucauccaacguauucaucgaacugagagaauacguauccuccuuuuccacggaacccucagcagccgauucccaagcggcgccccaauugaccuugcucacucucuguauuugaucgcccaacguuauuuccaagucuucgaguauguauucaucauuguaaccuucaucgcuauc

SEQ ID NO: 1831 - RNA, 260 nt, artificial sequence
  synthetic construct
gcaaacccauaauuuacuccgauagucgacuugacacaguggauuuaaaauagcccugcaguuguuccuugugcacaauacuggaucguauuguaugggaggaagaucuacucguucuuugauaggcugguagaggcaggcuaaugguaccaccaagcggguggcuucaauccugcuggagggccacacguuccacguaaaacggauaccaucucgguccucauuuuguugaauauauuccucguaaguagucaucuuuc

SEQ ID NO: 1832 - RNA, 241 nt, artificial sequence
  synthetic construct
guaaucaggccaaucaaagcguuuugcggcaacaaacucaacgacauuugcaaugaguccuuaagagaacccaauucuucuucauccaugcaaguaucgacaacauauaagaauaugggagguaaacauugaacucuguuuauuguguacucaauagucgagaacauaggcauuaauucagcaggcugguguuguucggagauagcugcguauuguugaggaaauggauuucucuggaagc

SEQ ID NO: 1833 - RNA, 257 nt, artificial sequence
  synthetic construct
guuagauucauaucacauuuugaaauagguugcaggaaucugcuaccagguggaacaggcgcagauugagguugucccggucucauagguuguccagguuguugcgguuguuguugaggauugugaggggccaucgagacuuuaccaauacccaacauuuccugaaccuguuuagccguuagauccuuaguuccucggaauacguacgauuugcucacaccuucggugccuaauucgugaacuugaaccauuuuccc

SEQ ID NO: 1834 - RNA, 258 nt, artificial sequence
  synthetic construct
gcuuucuucauauauuuugcauuaucuuuuuggauaucaugaugggaccuaauaggcuguuucaaaucgucauucaaaacuugaccaggaccuugugagcaagaacccccaacaaaaagcauaacccuagcucccguauuugcauagguacacuccaauaaaccgauagcaaucgauaaugcaacaccagugcaucugaguggccuuuuaccuugauguacaggccaaggaucuuucuguuguucuccuauuaaaucc

SEQ ID NO: 1835 - RNA, 248 nt, artificial sequence
  synthetic construct
gagaacauuucacuucuaauguuccguuaaaagccauuuucaaaucguuuuucugaucucgugugaacacccuuuggaauguuuguuuaaagagcgaugaauuaaaagaaucucccaucaccaugugaccaccuguagaauuagcacauuguuucauuuccauuaaaccaguuugaucaagugcacaggaauaaauaucaaugcaaugaccauuagucgcugcucucaucgcuaaaguaucauaaugc

SEQ ID NO: 1836 - RNA, 256 nt, artificial sequence
  synthetic construct
ggugguacaugaauugcggauagaggcuaaaguuuuggccuaaucugaaugaaccagcaucgucuuuguuguauucuccgaauuuuugacacaaucgaaucagcauucuaucgacccaucucagaacgucgggacucucaucugauucagcucuauaaacagccauucuggccauaauuacagcugcugcuuccugaucaaaaccagcgcugaugugguggauauuaguaguggcaucagcccaguuucgagccac

SEQ ID NO: 1837 - RNA, 243 nt, artificial sequence
  synthetic construct
gagcuauagucucuccguggaauaucaaaauuuggaaaaacguguccauaagcaguauucuaucgggcuguauggaacucguaucuaauagaacaggcuccggagggccguugaaacuguaacuguacaaaauugguugaaucaugaucaaugauugaguaagaucuucucucaucaacauaugucuauagaacgacguuucaucaggagaauuauugaaaacuugcaggaacugagaccucc

SEQ ID NO: 1838 - RNA, 297 nt, artificial sequence
  synthetic construct
gccguggacgaaacugccaauuuuuucaaaugauccauaaauacuugaagugauacaucgucuguuaaaacuggagcgccagcguccccuccauaugaauacauguuauugugagucugacucggauugacuuuggacaauaaaaaucuagccugcgauccuccuuguucuguaucgauauaucucggcauggggaaccuuguuuguaauaucucuugagcaucaucaauaggugcuugcaguaauugucuaaaguucucguauucgggcaugucuugguauuucaaauuucuccac

SEQ ID NO: 1839 - RNA, 248 nt, artificial sequence
  synthetic construct
guuugaauaaaauugugguacagcuggauuagguuguccgcuuucuguaauucugguuucuuuauaaacacuaguaauuugaggguuaauugaugccauaauuuuuuauuauggagcuccucaaguucugcccacucagagcccaauuccuucggacuuucuuuuuguuguuuagcaagauaaucacuaacauuagacgguugcaccgcagcugcagccauuuucugugaugacaagacaaaaauuuc

SEQ ID NO: 1840 - RNA, 252 nt, artificial sequence
  synthetic construct
guaaccccguccgcauuaucaaaggucgcuucgaccuccucgaugaucuuuuugguggugucuaaaucguuuaacuuaucaagguagaucuguccuucgaggacuuugcacaaguuuugggcauccggguugauuuuuacuuuggguucagucuuuucuaggaaagcgaucgcgucuuucgguuccuuguacuguucgacgacaauggccgcuauuucgaccaaagacaaaggauuaauuuuauuuucaaac

SEQ ID NO: 1841 - RNA, 247 nt, artificial sequence
  synthetic construct
gcuuuugcuuugcuaauaagacucaaaaauggccugguagccuuuaucagcuccgcuaguucuuuagccuugcccuccuuuuuguacuucucgcccaaguugaggauguccuguucuuuauuaacaauauucuccucgucaucuucgucugccggauuuaauuuuaacaacuugucauguugggaaggaacggacugagcucuuucgaauaacauugcaccagccauauuucuuacuucuucacugc

SEQ ID NO: 1842 - RNA, 246 nt, artificial sequence
  synthetic construct
gaccagcagguuuuugucguccaguuucuucaacucuuucaacaagguggauuccaguugcagggcgucgguguacaugccggugucgaaauacagggcgaugagacgcgcuuccagcgauuggcgcaaaaacguucuucucuccucuuucgcccauucuauacauucuuuacacaguugcaccucgaugccgauaccugccuccaaguccagaaaguaaucaaccagugaucuaacuaauuuugc

SEQ ID NO: 1843 - RNA, 246 nt, artificial sequence
  synthetic construct
ggucagagcuuugggggacucgacgcugucgaaacccucgaaggcuucguagaaauaggaguaagcggucuugaaguccuuuucgucggcugcaugcaguacgcccgacugcagaucgagggcggccugcaucuucggagggcaauagauggcauucgcggucguucuggcggacgucagggcggcccgggcuuuggguaaauugcuuagagcgugauauguuuugcuuucgagcaguugcacuuc

SEQ ID NO: 1844 - RNA, 250 nt, artificial sequence
  synthetic construct
guucuaacauauugucguagaguguuccuaaaugugcucuuacaauaacgucaucuuccagcucguguuugaauuguuuuacagccaguugaaaaucugcaagagaucuuuugugggcugcuugugcgacugcuuucauggccucgauaucuuuaccugcauacuuuauggcuaauuuuccacuaacaauuugcuguacaucuucaggacuauugaucauaauuuuggacaaaagcauguacuucagagc

SEQ ID NO: 1845 - RNA, 259 nt, artificial sequence
  synthetic construct
gacaacuuuuucgcuuuuugauagagaguaucuacuacuuuacucauacucuggaugguuucuagagccauuucauagguuuugucuaccgggguuucuucaaacacuaucaggacaccaucacccuggucuaaaauuccaugaaacuuggcaucuaaaaucaucugcgauaguuucuucucuacuuguaacacgggaagcuuaaucgucuuugcgauauauucuacuuggacacgugaguaagguucaaugauccugc

SEQ ID NO: 1846 - RNA, 247 nt, artificial sequence
  synthetic construct
ggcuuuuaauuccugcagggugaaaccgcguccagcacguauuuucgugugauaccuuacuguggggcaacguacgacgggucuuagggggccagcugcuggucugggggcgauagcgcgagccuucuugaugcgguucugccuucugcggauuuugcgggcggguugguugaaccagguuuucacgaaucguugccaauccuuguggaaauggccauucggaaucauguuauuaccuuuuggagcc

SEQ ID NO: 1847 - RNA, 245 nt, artificial sequence
  synthetic construct
guccuaaugcugggcugucugauaggcaacaccucucccugcaauugacuggccacuuuacguucuucuucgguggcuucgccggcccucaacuucuucuuguugugaauggggaacaggaucaacuuggauuuguauuccuucaaacguugggcguucaauugaauggauucaacggacuuguuccuccuucuguggucuacugcuacacccacgguccuggcgaaucugggguuaaguccugc

SEQ ID NO: 1848 - RNA, 240 nt, artificial sequence
  synthetic construct
ggauuucuucucuuucgcagcccccuuggugacaucuucagcauucucagcggcuuccuucauccucuuggcacggauaccgaccaaucuagcaucaguacgggacuuccucagaguuacguacgcuucgaauuucuucucguccucaguagguacucuagccguccuaaugcugggcugucugauaggcaacaccucucccugcaauugacuggccacuuuacguucuucuucgguggc

SEQ ID NO: 1849 - RNA, 251 nt, artificial sequence
  synthetic construct
gaauuguugaacgcaucuugauuuauaucgggcaacaaauugaaaauauccugcaauugauagaugaucugaugauugaugggcaguuuguuaucgcacacuugcaucaaauagucucuuauaucucucaauugcaaaugcaacccuuuaaggccuaauaacugauuaguaauccuuugagauaaaguucccacuguagugucuuuaauaucucuuaguaaauguucuacuccgacuuccucagcuucuuc

SEQ ID NO: 1850 - RNA, 211 nt, artificial sequence
  synthetic construct
guccuucuucgcuuccuucucuuuguccguuuuuuccuuauccuugucuuugcuaucuuuauccuuguuguccuuuuucucuuccuuuuugccuucuucugcgucucuguuggugaguuuguuguugauuagguugugcaaugcaacgauagaucgaacgagagccccuaaauaaacuacaagcauuugaucguuauuuuuaacauaaaac

SEQ ID NO: 1851 - RNA, 352 nt, artificial sequence
  synthetic construct
guuucacagcuucguccaacguauucauugaacuuagagaauauguauccuccuuuucuacggaacucucagcagccguuucccaugcagcgccccaauuaacuuugcucacucucuguauuugaucgcccaacguuauuuccaaaucuucgaguauguauucaucauuauauccuucuucgcuaucgggaaugccagucguaggaucgcaaucuuuaacgauaaacuucaacaccgccccgaacguaccgacgcaacucggcaaaucgucgucggggaacuucaaaauggcguaggugugauuggucucguuguaaugcagcugcuugcacgguaucaccgacagcaauuc

SEQ ID NO: 1852 - RNA, 267 nt, artificial sequence
  synthetic construct
guacaugccgaucauguucuucaacaugcccaccguuuuguagaacggacagaaucuaucguacgacgaguacgaguucuguugcaggaaaucuuccuucagcaacuuggcgauuuccaauguuauuuuaucggcuuccgccaacgaggccuuuccuaccagcugcacgauuuccguaagaucaucuucuucuugaagaauuucuuuaacuuugguucuuagcgguauaaauucagggaaguuuuugucauagaaaucaucuaaggc

SEQ ID NO: 1853 - RNA, 252 nt, artificial sequence
  synthetic construct
gccguugaaacuguaacuguacaaaauugguugaaucaugaucagugauugaguaaggucuucucucaucaacauaugccgauagaaggauguuucaucaggagaauuauugaaaacuugcaggaacugagaucuccuuaggugauacaugaauuggggauagaggcugaaguuuuggcccaaccugaaugaaccggcaucgucuuuauuguauucuccgaauuuuugacacaaucgaaucagcauucuauc

SEQ ID NO: 1854 - RNA, 194 nt, artificial sequence
  synthetic construct
gcccgauuggacauccugaaaauucacucgaggaaaaugaauuugaccagagggaucaauuugaggaaaaucgcggaauugaugccgggcgcuagcggugcagaagugaagggaguguguacugaggcugguauguacgcccuaagggagagaagggugcauguaacacaagaggauuucgaaauggcuguugc

SEQ ID NO: 1855 - RNA, 350 nt, artificial sequence
  synthetic construct
gcaacaaauugaaaaugucuugcaauugauagaugaucugaugauuaaugggcaguuugguaucgcccacuugcaucaaauagucucuuaugucucucaauugcaaaugcaacccuuucaggccuaauaacugauuggugauccucugagauaaagugcccacuguagugucuuugauaucucuuaauaaauguucuacgccgacuuccucggcuucuucugcgccuauuucgcucgggacguguucaaauguuuuggacguaggggagccaucaucguggacuucuucgaccgcuugguacgcuucaguaggaagccccagaucuuuagguuucgcaucgauaaucacc

SEQ ID NO: 1856 - RNA, 307 nt, artificial sequence
  synthetic construct
gcuucucuuugaugucacguacgauuucucuuucggcugucguggugaaagaguauccacguucggucaggaucuucaugagguagucggucaagucucugccggccaaauccaaacgcaggauggcguggggcagagcguaacccucguagaugggcacggugugcgacacaccgucuccggaguccaauacgauaccggugguacgaccggaggcguacagagagaguacggccuggauggccacguacauagcgggcguguugaagguuucgaacauaauuugcgucaucuucucccuguuggc

SEQ ID NO: 1857 - RNA, 305 nt, artificial sequence
  synthetic construct
guuucgaacauaauuugcgucaucuucucccuguuggcuuucggguugagcggagcuuccgucaacaguacgggguguucuucgggggccacgcgaagcucguuguagaaggugugaugccagauuuucuccauaucgucccaguuggugacgauuccguguucaaugggguacuucagagugaggauaccucgcuugcuuugggccucgucucccacguaggaguccuucuggcccaugccuaccaugacgcccuggugucuggggcgccccacgaucgaggggaacacggcccgaggggcguc

SEQ ID NO: 1858 - RNA, 306 nt, artificial sequence
  synthetic construct
gauuacagcuucuaugucugcaguagacguggcguauucaccuaauauccaaagagcagcacgaugaacuuucacagauuugaugucuuugaaugucucuaauaauuucucgauaaugagcggcuccaaauuaucgaauuucuguauggccucccucaaaaauagcaacacaucgguggccgccaauucauugcuaucggacagaaauuccaucagaacaggaaugacuguagcagcuauaucagggaauuugaugcaacaagaaugcaacguucuaacuaacaauugccuguauuucccaguauc

SEQ ID NO: 1859 - RNA, 309 nt, artificial sequence
  synthetic construct
gcucacuucacccaguagauugaaggcggacuccacuccaucaucggccacugcucuuugaacuucuucagcaucggcuaaacaaacuaguuugccgcuaucguauaucgagcgagguuguauuucgauccuaguuucccaaucguagaaggccaauccggauacagauuuuacacccaacagaccauagaugccuucggcuccaaacuucucuuugaaguucuugaauauucugaugguagauccggacucguuccucagcgccauggccguguaaaugauguauucuccaucguaaaugucgcaagc

SEQ ID NO: 1860 - RNA, 300 nt, artificial sequence
  synthetic construct
gacuccacuccaucaucggccacugcucuuugaacuucuucagcaucggcuaaacaaacuaguuugccgcuaucguauaucgagcgagguuguauuucgauccuaguuucccaaucguagaaggccaauccggauacagauuuuacacccaacagaccauagaugccuucggcuccaaacuucucuuugaaguucuugaauauucugaugguagauccggacucguuccucagcgccauggccguguaaaugauguauucuccaucguaaaugucgcaagcgcccaugucucgccgucuc

SEQ ID NO: 1861 - RNA, 291 nt, artificial sequence
  synthetic construct
ggauuccacgucucugguuuuuccuccuacacgcgguuucuggguagcagaugguguguaugaaggagguuugacaucguuugucggaauagcgauaccgaagccuccgcuguccuugccgccuuucuuuugcgcuuccauuuucugccuuugcaauucuuuagcuuuuucucucaucuuauucuucgcuucacgcuugagucugucugacagcuugguauacuuuuucccgugcgaauccauuuccacgaacgugcgaauuugagacagauucacgcucucucuauaacc

SEQ ID NO: 1862 - RNA, 298 nt, artificial sequence
  synthetic construct
guguggagcgggaacgaaggcuguuuuaaaccaauuucugaacgcaacgggugcguuugaagcuguuauucugccccauuucucgucuccuaugugcaagguugccaagccuaauauuucugcugcacgccgcccgggggcuuuaguuccgggcuuacuauucuuauuugggacaaugacguuuucaccuucggauuucaguugaucgacgaaggauuccacgucucugguuuuuccuccuacacgcgguuucuggguagcagaugguguguaugaaggagguuugacaucguuuguc

SEQ ID NO: 1863 - RNA, 306 nt, artificial sequence
  synthetic construct
gcaucacuaugcccaauuuugcugaucgugcgaaguagcgauugaguggggcuugaaaaagcuaaaauuaaucugcauaggcaagugaaugcgaguaaauucgcgaaaaugcauagcguuaguaucuuagcugggccuuuccugucgcuaagaaaaagcugagaguuaaaaauccagcaacacccuccuaauucuaauacuuuaccuacaaaggacgcguuacaguagccauuuauuauauccaaugauauaauguauauuaauaucauguuuucuaauauuaucacacaaaauauuaaauuuauc

SEQ ID NO: 1864 - RNA, 313 nt, artificial sequence
  synthetic construct
guuacuaugauuacaucgucugcggucgagcucagcucuuugaugccuagguacaccauucuucgaaguauuacguccuucgauuggaauaguuuggucauugcgaagaaaacgucuguugcuucuuuuacguuuaaagcuucccccugauuuaguagguaaaguaauuuggugagaauuagggugcauuuucuuggauucacugauguuucguuaaacacucgagcuucuuguaaaacagugguuuuuucgauauuuugaaauauguuuccaacuccgucuucuuccuccuuuuugucucuuuuaaaagagc

SEQ ID NO: 1865 - RNA, 308 nt, artificial sequence
  synthetic construct
guacaccauucuucgaaguauuacguccuucgauuggaauaguuuggucauugcgaagaaaacgucuguugcuucuuuuacguuuaaagcuucccccugauuuaguagguaaaguaauuuggugagaauuagggugcauuuucuuggauucacugauguuucguuaaacacucgagcuucuuguaaaacagugguuuuuucgauauuuugaaauauguuuccaacuccgucuucuuccuccuuuuugucucuuuuaaaagagcucauuuuaaugggauauauuuugaaaauuggaauauuuuuuacac

SEQ ID NO: 1866 - RNA, 311 nt, artificial sequence
  synthetic construct
gcuauuauucugauaagcauacaaacagcauaaggagauuucaggguaguucugguuaguuuagcuauuaauuuuguaacagccaaccuaucuguuuuucugaugugguauaggagccccaaggcgugauauugcaccauuacauuaucacuauuaauagcuuccugugcuucguuuacccaucuuuucaccacuucaggugccauuuuggucaugugcaaagagcugaccaaugcagcugaacugacagcggaauuucuaucuacgauugcuugcuucauguaccguucgauggcuuguagcaugguagc

SEQ ID NO: 1867 - RNA, 300 nt, artificial sequence
  synthetic construct
gcucgaugcauugcuccuuaccggcaggaaugaaauucuuaaauucgggaacgagcuuccuuccuugcucgaucuuccuucgcaggauguccugcuuguucagaaaaacaauaagguacacguuggaauagauggcggcuaucaggaacagcaccgauugaauucccgcgagcacgggcaucuugaacucgauuucggcauuuaccgcgucgauuuuguccagaaaauguucagcguugcuacaggagggucuauuuugucguauccguuuauguguaagauuuucauuugcuugaugac

SEQ ID NO: 1868 - RNA, 310 nt, artificial sequence
  synthetic construct
gaauaaucuagcucgaugcauugcuccuuaccggcaggaaugaaauucuuaaauucgggaacgagcuuccuuccuugcucgaucuuccuucgcaggauguccugcuuguucagaaaaacaauaagguacacguuggaauagauggcggcuaucaggaacagcaccgauugaauucccgcgagcacgggcaucuugaacucgauuucggcauuuaccgcgucgauuuuguccagaaaauguucagcguugcuacaggagggucuauuuugucguauccguuuauguguaagauuuucauuugcuugaugac

SEQ ID NO: 1869 - RNA, 300 nt, artificial sequence
  synthetic construct
guaauacuguugggccauuuuacgugcuugcuugaccaacaaacgguagucaggucccaucccggaauagaccauuccgaugugcuucgugaucauuucuacuuuauggacgcuguguucgucguaaagaauggauuugugcuuguuuucuguggcuauuaccacuccauuugaugcuuuuauuccuacugaaggagcaccagccgccacugccgcuaaagcauauucgauuuggacuaguuuaccugaagggcugaaaguuguuaaagaaaaacuauaacguucagaugacauuuucac

SEQ ID NO: 1870 - RNA, 306 nt, artificial sequence
  synthetic construct
gaccuaaaucauaagcuuccucaucggauaagucccauuuguauccagaaucaagcaccccgaaagcguaaauggaaccugaaccuacgcugaacacuuucccggcuguccuuagaccuucugaaucgacguaguagaguugaggaccccuuuugucccauccagccaacaucauucccauggacaaacccauuccuuuguaauuauaaaccauauuggccauuaacuuggaagccgcagccaccgaaauacguucccuguuucucaguucguacagccuacauuguuuagcuaauacucgguccc

SEQ ID NO: 1871 - RNA, 312 nt, artificial sequence
  synthetic construct
gcaaaaaacuguugauuuuuaugauuuuuucuacaguuugugauccaaugaauuggccuccaguggcucgggaauccacugcgaguacuacgccucccuuguacaugaaucccaauguggugguaccguggucgaacuuaauuuugaucucacggccauuaucaucuuuggugaaucuugcaaaguuauugcugggaucaggaaaaggcggaacggccaaguucaugccauucuugaaauuggugcaauacuucugcagacucucgucguaggcgagucgcucguaauccucggaauuguagcuuguaaugc

SEQ ID NO: 1872 - RNA, 312 nt, artificial sequence
  synthetic construct
gucccauuuguauccagaaucaagcaccccgaaagcguaaauggaaccugaaccuacgcugaacacuuucccggcuguccuuagaccuucugaaucgacguaguagaguugaggaccccuuuugucccauccagccaacaucauucccauggacaaacccauuccuuuguaauuauaaaccauauuggccauuaacuuggaagccgcagccaccgaaauacguucccuguuucucaguucguacagccuacauuguuuagcuaauacucggucccaguauguacaaucagccgcgccuccugccauuguagc

SEQ ID NO: 1873 - RNA, 319 nt, artificial sequence
  synthetic construct
guacuuuuucaacaaacgacgaaggacucucauacguugaauccauaauucuuuucuugguguucgagcguucgcuguaccuuuccuuuuaccaaaaccgcagugccuacccuuccugcgggcuucgguguucuugcggacacgggcacgugagugcacugcuacaggcuucuugaugaucaaaccaucuuuaaucagcuugcggauguuuugucuugaauuuguguuggcgauuucguugauuucguuaggauccaaccauaccuucuuuuugccgcaucucauaacagaggcugcgagccucuucuggaguuuuaac

SEQ ID NO: 1874 - RNA, 301 nt, artificial sequence
  synthetic construct
gacucucauacguugaauccauaauucuuuucuugguguucgagcguucgcuguaccuuuccuuuuaccaaaaccgcagugccuacccuuccugcgggcuucgguguucuugcggacacgggcacgugagugcacugcuacaggcuucuugaugaucaaaccaucuuuaaucagcuugcggauguuuugucuugaauuuguguuggcgauuucguugauuucguuaggauccaaccauaccuucuuuuugccgcaucucauaacagaggcugcgagccucuucuggaguuuuaacgaacuc

SEQ ID NO: 1875 - RNA, 308 nt, artificial sequence
  synthetic construct
guuugaccuucauucucuuggcguucgccuggucggccaacaucuuggcgcgagccuucucagccuucuucuuguggauguauuccaucaggacacgcuuguucuugaauacguuacccuuugccuucauguacagcgaaugguacagaugucugucgauuuucuuggccucacgguacuuuuucaacaaacgacgaaggacucucauacguugaauccauaauucuuuucuugguguucgagcguucgcuguaccuuuccuuuuaccaaaaccgcagugccuacccuuccugcgggcuucgguguuc

SEQ ID NO: 1876 - RNA, 312 nt, artificial sequence
  synthetic construct
gucuucuuccuuaacucuaucuuucuuaagaggucccauaaacgcagccuugucagcggcgguuuggaaucuaccguguccgaauuuggacgacguaucgaugaauuucaaauugaucuucuccaaagcaauacgcuuagugugaaccaagagagauuuucucaguguaaugacacgcuucuuaggucccauacaacaacccuuaaucaugacgaagucauuguuaacuucaccauaaugagggaaaccacccauugguguaauggucuucucacuaagaucguaaucgguagcagcauuguuuuugaugac

SEQ ID NO: 1877 - RNA, 309 nt, artificial sequence
  synthetic construct
guuacaccgaugcaaucgaucaucucaucuugagcgaaaacguugccaacgggaaugggcuucuccaaaugcuccuuagcccaugcgacuuugucggcaaugguaccuccguugaguugaauuuccauaauaugggcuuucuuuugacguuguuucaacaauuucaucugagugugagcgaugacucugacaaccuugcaguauuugacgauuuucuucaagucgcgcucaauggacuucuuacccaaaucaucgguccauuucuuggacgccuuggugaaagccuucuucuugcucuuguaccaguuc

SEQ ID NO: 1878 - RNA, 309 nt, artificial sequence
  synthetic construct
guuacuccaauaacgucaaucaucucaucagcugcaaagacauugcugauugcaacugguuuuuccaaguguucacgugcccauuggacuuuuuguucaauaguaccaccauugaguuggauuuccaugauguuagccuucuuuugacguugucucaacaauuucauuugugugugagcaaugauacgaacaacuuugcaguacuugacgauuuuuuugaaauccuuuucaauugauuugcguccaagaucaucagcccacuucuugcugguuuuggugaaugccuucuucuugcucuuauaccaguuc

SEQ ID NO: 1879 - RNA, 312 nt, artificial sequence
  synthetic construct
guuauucuuaacaaucuuuccguccuugguguggauaccuugaccaauucuguaaauuuucuuauucauuucuguucugugaugguaaccuuuuugaccagcacgugcaacagugaaugacacucugcuuggaugccacgcaccaauacaagcgaccuuucucaaaccuuugugagucuuacguggcaauuucuuugugugccaacgagauguaacaccuuuguauccuuugcccuugguuacuccaauaacgucaaucaucucaucagcugcaaagacauugcugauugcaacugguuuuuccaaguguuc

SEQ ID NO: 1880 - RNA, 305 nt, artificial sequence
  synthetic construct
guuuucucaguaagaucguauucaguugaagcguuauucuuaacaaucuuuccguccuugguguggauaccuugaccaauucuguaaauuuucuuauucauuucuguucugugaugguaaccuuuuugaccagcacgugcaacagugaaugacacucugcuuggaugccacgcaccaauacaagcgaccuuucucaaaccuuugugagucuuacguggcaauuucuuugugugccaacgagauguaacaccuuuguauccuuugcccuugguuacuccaauaacgucaaucaucucaucagcugc

SEQ ID NO: 1881 - RNA, 307 nt, artificial sequence
  synthetic construct
guaaccccagguaauguaagguucgcauauucuaagcauguugaugguagccuuguugagcuggacgaacacuccguuguugauuuggagcagccugaacaguuggaggacuuugcgaacuuucggggcaaccuuguugauacccuuaauacgcauuacgaaagcuaauuuagcuucggcuggaacguagaaguuucccuuguuuuuagcuuggcggaucaaccuaauuucaucucguuccuucagccuguacucuuuaauguauuguucggcccucuugaaaauaucuuuccucuucuugaugugc

SEQ ID NO: 1882 - RNA, 307 nt, artificial sequence
  synthetic construct
guaauguaagguucgcauauucuaagcauguugaugguagccuuguugagcuggacgaacacuccguuguugauuuggagcagccugaacaguuggaggacuuugcgaacuuucggggcaaccuuguugauacccuuaauacgcauuacgaaagcuaauuuagcuucggcuggaacguagaaguuucccuuguuuuuagcuuggcggaucaaccuaauuucaucucguuccuucagccuguacucuuuaauguauuguucggcccucuugaaaauaucuuuccucuucuugaugugcucggauuuuc

SEQ ID NO: 1883 - RNA, 304 nt, artificial sequence
  synthetic construct
gaaccaugauaaucccuccgauagaaacauccuucauugcaacguauugcgaguuaucauuaagcguaaucacuuucaguuguugccucaugguccuggcaggauuuugcaagauuucgaaacuaggcucgggcuccuuuuucuucuccuccuuaucaucuuucuuaucuuuuuugucgucgcucgacgacgccgcuuuuuuaucgucgguuuucuuaucaucggacuuuuucuccucuuucuugucuucgguuuucuucucuuucuccuccuuuucgguuuucuuaucgucuuuaucuucguc

SEQ ID NO: 1884 - RNA, 300 nt, artificial sequence
  synthetic construct
guaaagccagaacacugcgaucggcuuccggcaaaccgucacuaacagucguaguggaguugcuccggcaggcgagcaugcgguuaacgcaggcugugagaauggguggagaauuuugggccgcaauuuaggguagaucauacguugcggcuucggcauaauguuaucaagacagcuauuaggucgauugguuggauaucuccgcaggauauagaaauuggggcuggauucagcggagaaggcuauucgagaugggguuauugcuacuuuggacccacaagggggguguacuaaagagcc

SEQ ID NO: 1885 - RNA, 308 nt, artificial sequence
  synthetic construct
gcaacgauagaucgaacgagagccccuaaauaaacuacaagcauuugaucguuauuuuuaacauaaaacgaauuguugaacgcaucuugauuuauaucgggcaacaaauugaaaauauccugcaauugauagaugaucugaugauugaugggcaguuuguuaucgcacacuugcaucaaauagucucuuauaucucucaauugcaaaugcaacccuuuaaggccuaauaacugauuaguaauccuuugagauaaaguucccacuguagugucuuuaauaucucuuaguaaauguucuacuccgacuuc

SEQ ID NO: 1886 - RNA, 304 nt, artificial sequence
  synthetic construct
gcaguuuguuaucgcacacuugcaucaaauagucucuuauaucucucaauugcaaaugcaacccuuuaaggccuaauaacugauuaguaauccuuugagauaaaguucccacuguagugucuuuaauaucucuuaguaaauguucuacuccgacuuccucagcuucuucugcgccuauuucgcucgggacguguucaaacguuuuagauguaggagagccaucaucauggaccucuucuaccgcuugguaugcuucaguaggaagccccagaucuuuagguuucgcaucuauaaucaccaagac

SEQ ID NO: 1887 - RNA, 316 nt, artificial sequence
  synthetic construct
gcuaucuuuauccuucuuuuucucuuccuuuuugccuucuucugcgucucuguuggugaguuuguuguugauuagguugugcaaugcaacgauagaucgaacgagagccccuaaauaaacuacaagcauuugaucguuauuuuuaacauaaaacgaauuguugaacgcaucuugauuuauaucgggcaacaaauugaaaauauccugcaauugauagaugaucugaugauugaugggcaguuuguuaucgcacacuugcaucaaauagucucuuauaucucucaauugcaaaugcaacccuuuaaggccuaauaac

SEQ ID NO: 1888 - RNA, 118 nt, artificial sequence
  synthetic construct
aggaucgucuguguaaaaacgcauuccaccaguaccugcucgugguuguuuuucuuugccucacgcugccuuucgaaggagaccuuccaccagaaccauuuguagaacucggugaagc

SEQ ID NO: 1889 - RNA, 302 nt, artificial sequence
  synthetic construct
guauuaacauguuugcaccaaucauugagucuuguuaccauacuagagaucugagugcgaucuaaaacucucgguugaacccaugucauguuuaccguacuggcaaccugaucaauugccccuuuaacuaagccuugugaaagcgccuucauuaccagcaguucaauuucauugagagguaaccucguuucuuuugaaauuucugcaaauguuaacugccuguuaugggacggucuguuaaaugucaucuccaucagacauaauaaggauaucuucugucuuaagaauaguuccucgguggc

SEQ ID NO: 1890 - RNA, 109 nt, artificial sequence
  synthetic construct
ugcccaagaaaaugcucugcuaugcuaaggaccacgcuagcauucaacucaggucgccgacguugauccuuuaaccggaagaaccgaaaguuccaagagcgcucucugc

SEQ ID NO: 1891 - RNA, 315 nt, artificial sequence
  synthetic construct
gaucauacacaaguuguuggauucaaacuugauguaaucgagaauuuuagacguagcgaucuccaauugaauugugucguuuaccuugaugacaggaucaggguaacggauuguacgaccaucgugggucaccaaaaacggaauuccuuugggaccgguuugaacccucuuaacuuugcaaagcuuguauuuagcuucuucagcaguaauacgguggauagcaaaucuuccuuucacaucauagaugagacggaaaaauucaccaguuuuuucaauggugauaacauccauaaaaccugcgggguaguuggaguc

SEQ ID NO: 1892 - RNA, 305 nt, artificial sequence
  synthetic construct
gugauaacauccauaaaaccugcgggguaguuggagucgguccugacuuuuccaucgacuuugauuaaucuuugcauaacuauuuuaguuaccucgcuguuagugagagcauacuucagccuguuucuuaagaaaaucaccaaggguaaugauucucggaguuugugaggaccgguggacgggcggggugcgaauacaccucccaauuuguccaacauccaugcuuucggcgcauuuaaacgcuucaagugcuuuuuagguccccgagccaucuugacuuuaaaaauaugaaagacagagcaggc

SEQ ID NO: 1893 - RNA, 308 nt, artificial sequence
  synthetic construct
gcuucuucagcaguaauacgguggauagcaaaucuuccuuucacaucauagaugagacggaaaaauucaccaguuuuuucaauggugauaacauccauaaaaccugcgggguaguuggagucgguccugacuuuuccaucgacuuugauuaaucuuugcauaacuauuuuaguuaccucgcuguuagugagagcauacuucagccuguuucuuaagaaaaucaccaaggguaaugauucucggaguuugugaggaccgguggacgggcggggugcgaauacaccucccaauuuguccaacauccaugc

SEQ ID NO: 1894 - RNA, 308 nt, artificial sequence
  synthetic construct
gaauuacauacucucuuucugcucuaauggcgaauaguccugcuucaguacacacauuucuuaaaucagccccauugaagguaucagacaauuuaacgauagcuucauaaucaauuuccccgugcuuagcaauaggaagugcgugaauuuucaaaauuucaagacgagcuuguucguucggcaggggaaucucgauuuuccuguccaaacgacccggacggagcagagcaggauccaauguaucaggccuauuggucgccauaaucauuuuuacuuguccuaacgaaucgaacccauccauuugauuc

SEQ ID NO: 1895 - RNA, 307 nt, artificial sequence
  synthetic construct
guacacacauuucuuaaaucagccccauugaagguaucagacaauuuaacgauagcuucauaaucaauuuccccgugcuuagcaauaggaagugcgugaauuuucaaaauuucaagacgagcuuguucguucggcaggggaaucucgauuuuccuguccaaacgacccggacggagcagagcaggauccaauguaucaggccuauuggucgccauaaucauuuuuacuuguccuaacgaaucgaacccauccauuugauucagcaacuccauaagcguccuuuggauuucucuaucagccgauguac

SEQ ID NO: 1896 - RNA, 306 nt, artificial sequence
  synthetic construct
guggcucauguuguauacuaaaggaucaacuucucucgguaaguaccgcauuaugguuaagguggucaugucgagggcuacucuugugccggccuuuaacuuggcuuuauccagcugacgacggcaaccgacuacguaacgaggaccguuuguugccuuuacaaugaauuucucuucugucaguugcuucagaacuucaccaacgauuugccccauacuuugaagggcuuucaaaucguuuucugauuuaucguacugcuugguuaaaucuuugagcuguucucgcauuucuuucagccuggauuc

SEQ ID NO: 1897 - RNA, 316 nt, artificial sequence
  synthetic construct
guaacuucucgauuugcuccuugcaaccgccuacaucgcuguaaguuacguccgguuucucuuccaccugcaucauaguaacaguaggaucgauuuugggcgguagugguaugugaauuugguauuuguuucgauccacaccgacucucaugcccucuucgauguccguaggagcgaccgaaucggcuaaauccaccacgaauuuggcgaauuguuucacguuuaugauguauuugggaucaucgguaucggcguugaugauuuuagugcaacgggccacuugcaguggcuguucguucugcaguguuuguuuguc

SEQ ID NO: 1898 - RNA, 287 nt, artificial sequence
  synthetic construct
gccucuaaaaagucuuuuucgguagccacuuuucuccuugcccuuaucgcaaacaugcccgccucaguacaaacgcuucuaauuucagcaccagucgaauucggacacaaucuagccaacaacucgaaacgaaugucccuuucgacugacaucgaucuagcguggauuuugaauaugugagaacggccuuccaaaucgggcaggccgaauucgacuuugcgauccaaacggcccggucucaucagagcaggauccaacguguccggucuguuggucgccaucagaac

SEQ ID NO: 1899 - RNA, 317 nt, artificial sequence
  synthetic construct
gcuaaauccaccacgaauuuggcgaauuguuucacguuuaugauguauuugggaucaucgguaucggcguugaugauuuuagugcaacgggccacuugcaguggcuguucguucugcaguguuuguuugucggcagccaaaucccauagagccggcggggccaagccggugucugauucuuuuauaccggucaguucguuuacacguuugaugauaguuuggauguccucuucgcauguuuugaugguuuugguguauuggccuuguccguagguuuuuaguagggcuauaucuccuucaucgagggcuuuuauuuc

SEQ ID NO: 1900 - RNA, 312 nt, artificial sequence
  synthetic construct
gauuucuucuaaaguacccacagacauugguguaccucugagaucaucgaccuuggaccuuucuuccucguucuucuccucuuggggcuucagucgcuccugguugcggauaaauuccuccuccaugagaagguaguccuuuaugcgcuccaguuugagcagcuucaaucugcaucuagugugcggaguuacggccgguaguuucagagcuguaucggggccuuuggugcgccucuucuucuugcccacucuggucgguaucgggggcucguacuuuuucuuuuuaucuuuuucgucuuucuucucgccgcc

SEQ ID NO: 1901 - RNA, 312 nt, artificial sequence
  synthetic construct
gauucccauuucuucguaguauucaggaugagugaguggcaauucaacggacucuuuaaucucuugaauuugauuguccaauccuccgauaucggcguaagucucuugcggggcuuucuccaauuucaucaccguuaccaucggaucggugucgucgccuaggacucccacuacagcgugcaccuugugauuaagaaguaccgaacacccugguucuaauugauccuuaucgacaaacgauaaaaugcuaacguaauguucgcugccuacagagguagaaacuauagcaugguuaucaucgaugauuucuuc

SEQ ID NO: 1902 - RNA, 306 nt, artificial sequence
  synthetic construct
gauuucuucuaaaguacccacagacauugguguaccucugagaucaucgaccuuggaccuuucuuccucguucuucuccucuuggggcuucagucgcuccugguugcggauaaauuccuccuccaugagaagguaguccuuuaugcgcuccaguuugagcagcuucaaucugcaucuagugugcggaguuacggccgguaguuucagagcuguaucggggccuuuggugcgccucuucuucuugcccacucuggucgguaucgggggcucguacuuuuucuuuuuaucuuuuucgucuuucuucuc

SEQ ID NO: 1903 - RNA, 283 nt, artificial sequence
  synthetic construct
guuguugagagacacugauaacuuggaaaacaacacaguuaaaagcaucauacuauggcuggacccaucgcucgauauaacaauggagaggcuauggggccacguggacgucuucgcagucggacacuucuugggcuggauguucaaggcgguacucaucagacacugggagaucaccgaacuggccuuccccaucuccugcccaacuucaucgagugcuggugggacgcuuugagcaucuggugcggcuugaaaaucugcaagaugcaaugcgcgaguacac

SEQ ID NO: 1904 - RNA, 303 nt, artificial sequence
  synthetic construct
gcacuaauuuggcgccgaugaacaucuggacuaacugaggaccggccaguuugcguuugggcggcgcaggcuaggaggguuuuuccggugagaacaccuuuaggaggucccaaauuaacgaacuugucuuucauagguaguacaacagccucgauuucuuguauuuguuuaucuaaaccuccgauaucguacuguucagauggccuuucgucgacuuccauagccuugacucuggcaucguacucaauuagauaagagucuuuguugacucccacuagaucacccgguuucaauuuccucauc

SEQ ID NO: 1905 - RNA, 300 nt, artificial sequence
  synthetic construct
guugauccaacgaugccgguauucugaucuacugcuucuaggaauuggccgauaaccagcgguacugauuggauacguuugacuucuucuugugcguguagguacuccuuuuucaaguuccucugcucgucuuugauguacucuuccuggacuucaaggaauuccaagguuugcuguaguuucuuguauuucguguacaaauccuccaugucuagaucuugcaggacuugcuugacuucggaagggcugccuuccucuuucucugguauuacaauauccauagccuccauuguugaugac

SEQ ID NO: 1906 - RNA, 297 nt, artificial sequence
  synthetic construct
guuagcgucgauaaggaauacaauggcgucuacggcugggaaguaguccuuccauacucuucgagccugcgaauggccuccuagaucgaacgugguaaaccucauguucccgauggacaguucuucagaagugggauguaacgugggcaagugcugggcuaaucuaucgucuuuaagcauguguaauaaggugguuuuaccagcguuauccagcccuaaaaacagcaauuucccggacuucuuccauaauccuagguagcccagcacucccgugaaccaaucccauaugaacauuuc

SEQ ID NO: 1907 - RNA, 309 nt, artificial sequence
  synthetic construct
gauuuuauugccuagaaucagcacggggcaguuggccaggguuucgucugucaacagcgcgucgagcucccguuugcuuucuccgaaucgagaucugucguuagcgucgauaaggaauacaauggcgucuacggcugggaaguaguccuuccauacucuucgagccugcgaauggccuccuagaucgaacgugguaaaccucauguucccgauggacaguucuucagaagugggauguaacgugggcaagugcugggcuaaucuaucgucuuuaagcauguguaauaaggugguuuuaccagcguuauc

SEQ ID NO: 1908 - RNA, 306 nt, artificial sequence
  synthetic construct
guuucucaacucauccucagacgccgcgucggguaaaucgauuuuauugccuagaaucagcacggggcaguuggccaggguuucgucugucaacagcgcgucgagcucccguuugcuuucuccgaaucgagaucugucguuagcgucgauaaggaauacaauggcgucuacggcugggaaguaguccuuccauacucuucgagccugcgaauggccuccuagaucgaacgugguaaaccucauguucccgauggacaguucuucagaagugggauguaacgugggcaagugcugggcuaaucuauc

SEQ ID NO: 1909 - RNA, 309 nt, artificial sequence
  synthetic construct
guaucauaaugcuuaauagcuuucuucauauauuuugcauuaucuuuuuggauaucaugaugggaccuaauaggcuguuucaaaucgucauucaaaacuugaccaggaccuugugagcaagaacccccaacaaaaagcauaacccuagcucccguauuugcauagguacacuccaauaaaccgauagcaaucgauaaugcaacaccagugcaucugaguggccuuuuaccuugauguacaggccaaggaucuuucuguuguucuccuauuaaauccguuagauucauaucacauuuugaaauagguugc

SEQ ID NO: 1910 - RNA, 319 nt, artificial sequence
  synthetic construct
gaacccaauucuucuucauccaugcaaguaucgacaacauauaagaauaugggagguaaacauugaacucuguuuauuguguacucaauagucgagaacauaggcauuaauucagcaggcugguguuguucggagauagcugcguauuguugaggaaauggauuucucuggaagcaaaaguugcaaacccauaauuuacuccgauagucgacuugacacaguggauuuaaaauagcccugcaguuguuccuugugcacaauacuggaucguauuguaugggaggaagaucuacucguucuuugauaggcugguagaggc

SEQ ID NO: 1911 - RNA, 311 nt, artificial sequence
  synthetic construct
guuacauauaucguauccgcuggauuggaaguaaaccaaugagaaguaaauaauuugucaaaauguuggucuaaaucaacaaauaauucuucuaagagauuaugaacugcgucauuucgcauuuuaauauacguuguuuuuaaugcuccaaaauuucuaguaaguucaugugaacuauuauucguaacauauucuuuuuccagcugagaaccuaauucaaugaguugggauauauuguugauaauuaagaucauguauuguguaaaauaaacaaccuguuuccugucuucaaaauacuuauuuuuaaauuc

SEQ ID NO: 1912 - RNA, 319 nt, artificial sequence
  synthetic construct
gcaacuuuaucucuaacuucagaccuugauaggucgccucucaaauuaaguaaccuaagaagaugaucaucugugauaucagaauaccucucaacaacccugugaaguucaaaugacagcauaucaucaucacucuucagaacuucugcgagcauaaugaucgcuucaaaaggauuuucgcauucaaugucuuuacuaagguuuuggaacaaucuguugaaccgguuggcuucuucugaugcuuucugagcggcuuucaugcauucgucguaaguuuuaaacgauacacgccgggagagcauggcugugagguauuuuc

SEQ ID NO: 1913 - RNA, 310 nt, artificial sequence
  synthetic construct
gauaaaaugaauguuaguuguuuuucuaacaauuuugauaagaccuccacaucggcaaaauaugcuuuuaacaucgauuugucaugcaccgacugauuagguaauuuaugcaauucaaagaguaggucaucucuggaguuuuccaaaucccucaaacauugauguguaugcaacaauuuuccuucauuaauccaagcuuucguuuucucgacacuuucaggaacuguaaaaaugugcuuaagauuuucuuuagcuguuacauacugggaaugucgcauguuuucgucucuaauaucaacaagguuuuugc

SEQ ID NO: 1914 - RNA, 284 nt, artificial sequence
  synthetic construct
ugaaaaggaugugggccaggacauguuauauaaaaaagaguuuuuagaaaagaaaauagaggaauauacacuaguagccaaaaaugcaucaaagaauaagagagucgcgccuacaaucgaaaugcaaagggaggcccaaggagccagcaccaacacagccgucuuagaaugaagaaugcagcugaagcucuccaaaaacaaaaacuugaaugucgaugauguccacgacaucauggaugacauagaacagcaugacauugccaacgagauuagguaggcuucgc

SEQ ID NO: 1915 - RNA, 308 nt, artificial sequence
  synthetic construct
gccauaucguacaucccaaucauguucuucaacauacccacgguuuuguagaagggacagaaucuaucguacgaugaguacgaguucuguugcaggaaaucuucuuucaacagcuuggcgauuuccaauguaaucuuaucagcuucagcuaaugaagcuuuuccuaccagcugcacgauuuccguaaggucgucuucuucuugaaggauuucuuuaacuuugguucuuagcgguauaaauucagggaaguuuuugucauagaaaucauccaaagcccucaaauauuuagaguaugaacucagccaguc

SEQ ID NO: 1916 - RNA, 308 nt, artificial sequence
  synthetic construct
gaauucugucucaaguacuacuucaucuacuguguaauugccugguucagcaauguacguaacgguaccuuuagcuuuaggcgguagaagcauuuugugcuuuacgagaguguuuucguggacuauaccguagaugucgccuccgguuaagugagagcccaucuugauguugauggguuggaaaucccauuuggccguucuggauagagccgguacguugauaccuuuggggauguagaugcucuccguuagcacguugaugucuuucaagggacguuggauaccgucgaaaaucgaacccaugauac

SEQ ID NO: 1917 - RNA, 306 nt, artificial sequence
  synthetic construct
gauuuccaauguaaucuuaucagcuucagcuaaugaagcuuuuccuaccagcugcacgauuuccguaaggucgucuucuucuugaaggauuucuuuaacuuugguucuuagcgguauaaauucagggaaguuuuugucauagaaaucauccaaagcccucaaauauuuagaguaugaacucagccagucgacagacgggaagugcuuacguugggcaagcuucuuguccaauccccaaaacacuugaacgauaccaagaguagcagaagugacaggaucagagaaaucaccaccaggcggcgacac

SEQ ID NO: 1918 - RNA, 303 nt, artificial sequence
  synthetic construct
gauucucucaauaguaggaucguucgccaaauucaagaacaaacaaacguucuccaucgaaccguucucuucgaaaucuuguuugaagaaacgagcaguuuccauguugacucccauagcggcgaacacgauggcgaaguugucuucgugaucguccaaagccgacuugccgggcaccuugacaagaccggcuugucuacaaauuugggcggcgauuucguuguggggcagaccagccgccgagaaaaugggaaucuucugaccacgagcgaucgaguucaucacaucgauggcggagauacc

SEQ ID NO: 1919 - RNA, 305 nt, artificial sequence
  synthetic construct
gaugauucucucaauaguaggaucguucgccaaauucaagaacaaacaaacguucuccaucgaaccguucucuucgaaaucuuguuugaagaaacgagcaguuuccauguugacucccauagcggcgaacacgauggcgaaguugucuucgugaucguccaaagccgacuugccgggcaccuugacaagaccggcuugucuacaaauuugggcggcgauuucguuguggggcagaccagccgccgagaaaaugggaaucuucugaccacgagcgaucgaguucaucacaucgauggcggagauac

SEQ ID NO: 1920 - RNA, 307 nt, artificial sequence
  synthetic construct
gcauagucaagauggggauuugggugauggagccguugcggcccuccacacguccggcucguucguaaaugguggccaaaucgguguacauguaaccggggaaaccacgucuaccgggcacuucuucccuggcggcggauaccucacgcaaagcuucagcguacgaagacauaucagucaauaugaccaagacguguuucucgcauugauaggccaaaaauucggcugcuguuagagccaaacgaggcgugaugauucucucaauaguaggaucguucgccaaauucaagaacaaacaaacguucuc

SEQ ID NO: 1921 - RNA, 305 nt, artificial sequence
  synthetic construct
guuaucgaucauguaacuguaggugaugaaguccaggaauguggacagggguucuacggcuugguuacgcauaugcuggaacucgaugacgaguuuuucccucaauuugucgucgaugguggauacugacaauggggaggguucguuggccaggaacgugccguagucggugccuuguaaaugcagcuucaaaucuuccagaguuucgcauugcacuaaauugagguaaucggcuugcuucaauaugccgcauuugaagccgcggcauagaccuuccaaguaaccguugucgauguuaaaaagac

SEQ ID NO: 1922 - RNA, 308 nt, artificial sequence
  synthetic construct
guugauguucaggcgcacuucaugcucgaagaauuuguccuccaacgucuuaucucccggauuguuuccagcccccucgaacaauuuggaguacucagcauaauacucggccacagcuuugaccugcucguaauccucagcucuagcuagagcggccaaaccaucaggcuggaguuuuccgcaacgcggguacaacuuagcgcggucaucuuugcucaauuccguuccgaaggaguugauagugauaaugauagcacgucuaucggcuucgaaagccaggauuucgcacaugcugucagcaguggugc

SEQ ID NO: 1923 - RNA, 301 nt, artificial sequence
  synthetic construct
guccaggaauguggacagggguucuacggcuugguuacgcauaugcuggaacucgaugacgaguuuuucccucaauuugucgucgaugguggauacugacaauggggaggguucguuggccaggaacgugccguagucggugccuuguaaaugcagcuucaaaucuuccagaguuucgcauugcacuaaauugagguaaucggcuugcuucaauaugccgcauuugaagccgcggcauagaccuuccaaguaaccguugucgauguuaaaaagacaccccuucaugaucgaaaaucgaaac

SEQ ID NO: 1924 - RNA, 295 nt, artificial sequence
  synthetic construct
ggcgucuucuagcacggcccucacguggucuucucucacuuucaacaccuucaaucuggccugguucagcauguuggacgauuggauuuucuucuggagcucgacuuguuucuccuucuucucguaguauuccaugaucuugaggcgcugcuguuggaccaaacggcccuuuucuauguugaacuccuccucggcuuuggcaucgauuucuucggccuucucguuggccucuugcucgaugaaagccaucaugugcuugaucuguuucuggacaucugcgucgcucagagccauc

SEQ ID NO: 1925 - RNA, 308 nt, artificial sequence
  synthetic construct
guuacuucuuucucgaacagcugguagaguccuugaaggaugaggcuuucgaugauguggccguacuuucccuggucucgggugacuucgccgaggcgcuugcgggcgucuucuagcacggcccucacguggucuucucucacuuucaacaccuucaaucuggccugguucagcauguuggacgauuggauuuucuucuggagcucgacuuguuucuccuucuucucguaguauuccaugaucuugaggcgcugcuguuggaccaaacggcccuuuucuauguugaacuccuccucggcuuuggcauc

SEQ ID NO: 1926 - RNA, 310 nt, artificial sequence
  synthetic construct
gcacccugaccguuacuucuuucucgaacagcugguagaguccuugaaggaugaggcuuucgaugauguggccguacuuucccuggucucgggugacuucgccgaggcgcuugcgggcgucuucuagcacggcccucacguggucuucucucacuuucaacaccuucaaucuggccugguucagcauguuggacgauuggauuuucuucuggagcucgacuuguuucuccuucuucucguaguauuccaugaucuugaggcgcugcuguuggaccaaacggcccuuuucuauguugaacuccuccucggc

SEQ ID NO: 1927 - RNA, 308 nt, artificial sequence
  synthetic construct
guuuucucucaauuucaguaucaccauguagaccaaaucggugucgccgcuuucgauggcuuugaugagagccggcacguuuucgcccaauuccaacagcaauuucacuugaucgcucgcuuuggauucguaaucuaaaaguuuaauugccaauuucuuccuuccgaauuccgaggcggugcuagcuauuucgcuguacgaaaucccagaugaguaacccaguuuaucggcuaugucucuggcuacgguuucuucgucuaaaugcgauuggcucaccuuguauuuagcccaguggacuaggauguaac

SEQ ID NO: 1928 - RNA, 307 nt, artificial sequence
  synthetic construct
gaucucucacguuauucaguacucuuaauauccugcacauauucacguaauugucggaucucaugucggguaugaagcauuuaccaaacugcgcggcucuuaguagaagcuuuugcacgucuacaucaaacucguaacugacggcuucuaugcauugauuaacggccguuuccagaucguuuuucaccaagcaaauguacucguuggcuuuguggcuuccuuucuggaauuguuuggaagcuucgagcagaaagcugcccggauccgugcuguugauucuaaauaucuucugaacaacuuccgguac

SEQ ID NO: 1929 - RNA, 312 nt, artificial sequence
  synthetic construct
guuuucucucaauuucaguaucaccauguagaccaaaucggugucgccgcuuucgauggcuuugaugagagccggcacguuuucgcccaauuccaacagcaauuucacuugaucgcucgcuuuggauucguaaucuaaaaguuuaauugccaauuucuuccuuccgaauuccgaggcggugcuagcuauuucgcuguacgaaaucccagaugaguaacccaguuuaucggcuaugucucuggcuacgguuucuucgucuaaaugcgauuggcucaccuuguauuuagcccaguggacuaggauguaacuggc

SEQ ID NO: 1930 - RNA, 308 nt, artificial sequence
  synthetic construct
gcauuucuucacuaauaauugcugccaauuccucuucgacagcugccucaucuucaucgguuaguuggccgcuaaguaauucguugauuucauuuuguuuuucaacgccuucccuuguuucguccaacauucuuucgauauccucgauauucagagaagcguuaauggucuuaagagcuucguuacccguuuuaaguccuucgacuacuuguguuuccacuugggcaaauucuauaucacuagacaaguuuucuagauuguucaguugauuaucaaguuucgagagaaguugcucuugauaucuuuuc

SEQ ID NO: 1931 - RNA, 316 nt, artificial sequence
  synthetic construct
guuucuuaacugucuccuuuucuuccucuuccucuucaguuucuucaucuuuggcaguuucgcuaacuuguacuugaggcuguucuguaggcacugcgggcauuucuucacuaauaauugcugccaauuccucuucgacagcugccucaucuucaucgguuaguuggccgcuaaguaauucguugauuucauuuuguuuuucaacgccuucccuuguuucguccaacauucuuucgauauccucgauauucagagaagcguuaauggucuuaagagcuucguuacccguuuuaaguccuucgacuacuuguguuuc

SEQ ID NO: 1932 - RNA, 308 nt, artificial sequence
  synthetic construct
guuuccacuugggcaaauucuauaucacuagacaaguuuucuagauuguucaguugauuaucaaguuucgagagaaguugcucuugauaucuuuucuucuuaagaaguaauuuagcucgcucuuuuugaccauuguuuaauaauaucuuagcuaauucucugucuuuaauuagggacaauucuauucuucuuugauauuguuuaacuuuaucccuuugcuguuuuaauugcaaaauggcuuuauccuguucuguaacucuagucggcuuuuucuucuuaccaaauauuauacccaucgcaagaucuac

SEQ ID NO: 1933 - RNA, 310 nt, artificial sequence
  synthetic construct
gcacuuuaucuaucucaguuugcgccgcuuccuccaucuccucagaguccucgagauccuccauggucucguccagcaucuccucgaugauaccggcuuucaucaucucuuuggacaugucuugcaucgucugcgccaccuccggcacccguacgagccucugcauggucugcaugaccuccguggauuuuugcagcgagcccgacacccugagaguggcuaauugguuuuucauuugcaacauuacggaauugaggugggcuuuggacguguagaucuuguugauggcuuuacgagaguuuaugauuuc

SEQ ID NO: 1934 - RNA, 307 nt, artificial sequence
  synthetic construct
gcuuucaucaucucuuuggacaugucuugcaucgucugcgccaccuccggcacccguacgagccucugcauggucugcaugaccuccguggauuuuugcagcgagcccgacacccugagaguggcuaauugguuuuucauuugcaacauuacggaauugaggugggcuuuggacguguagaucuuguugauggcuuuacgagaguuuaugauuucuuuggcgaguauuaggcagguguccuugucguuuuucuuggcugcuuccuuuagggaucgcuugacuuuuucuuccucucgcuguauggauc

SEQ ID NO: 1935 - RNA, 314 nt, artificial sequence
  synthetic construct
guuucuuuuuccucauaacuuccaguuugugcgccauuugcauuugccgcaaccucuccuguucuucagcuucucuucgcaauuuuucauuguguuccucgcguagagcauccaaagccgcucuggcauccuucacuugggucauuuuauccugcaagcacucguaauggaugcggcuaucaucguguucuugaauguaauggaguagucgcgagugcauagcuguuauauucaugaacagaguuuguacgcucguaucauucgcaauagaucucccucugcuggaguuacuuuucauccuguugaugaaaauc

SEQ ID NO: 1936 - RNA, 303 nt, artificial sequence
  synthetic construct
guaauggaguagucgcgagugcauagcuguuauauucaugaacagaguuuguacgcucguaucauucgcaauagaucucccucugcuggaguuacuuuucauccuguugaugaaaaucucuacguggcccuuuaaggucuucaugaaaucuuccagaucguuaucgcccaaaccguuuucuuugguuuugaauuuagguucgauguuuugaaugggagcgguggcgggggccgacgggcucauaggacggucguuuugaucguugguuuuagauucccaauaagaucuguucaaauaucuagc

SEQ ID NO: 1937 - RNA, 309 nt, artificial sequence
  synthetic construct
guuauauucaugaacagaguuuguacgcucguaucauucgcaauagaucucccucugcuggaguuacuuuucauccuguugaugaaaaucucuacguggcccuuuaaggucuucaugaaaucuuccagaucguuaucgcccaaaccguuuucuuugguuuugaauuuagguucgauguuuugaaugggagcgguggcgggggccgacgggcucauaggacggucguuuugaucguugguuuuagauucccaauaagaucuguucaaauaucuagccaauucgguguuagauucaacuugcgguugaggc

SEQ ID NO: 1938 - RNA, 299 nt, artificial sequence
  synthetic construct
gguuuuuccgaucaucuuuucauugccaggacugguaacuccuugcgaaggcgaaugagcggauuccaaagccuuaacggcguccauggacgguccgagcauacuuucaugcuccacuuuucucaacuggggccccaauggcuuaucccaagcgcacguugacauaguagcggguauaccauuaucuuucaucacguagacauucauguuaucuccaaucggaugguuuugcuguuguugcugcugcugcugcuguaucugcuugccccaucccggugguacugcggugucuguuccac

SEQ ID NO: 1939 - RNA, 310 nt, artificial sequence
  synthetic construct
gcuccucuuuaaugcuguccuuaauuuucucugcgggagccgccaccgaacaaccggagcucguucccaaaacgguuuucacgguuccugccguauugguguugucguucauuuucccuuccucagacuucucguuuuggcucugauuaccauaauacugucgguuggguguuuuguuggauguauuccuaugcuuuugauucgcugaauucugcuguacuuggaaauuuacgggucucugaauaggcguuggauaccuuugcauauuagauccgccuacuccuugauacaaauuguacuucugcugcgc

SEQ ID NO: 1940 - RNA, 308 nt, artificial sequence
  synthetic construct
gcuccucuuuaaugcuguccuuaauuuucucugcgggagccgccaccgaacaaccggagcucguucccaaaacgguuuucacgguuccugccguauugguguugucguucauuuucccuuccucagacuucucguuuuggcucugauuaccauaauacugucgguuggguguuuuguuggauguauuccuaugcuuuugauucgcugaauucugcuguacuuggaaauuuacgggucucugaauaggcguuggauaccuuugcauauuagauccgccuacuccuugauacaaauuguacuucugcugc

SEQ ID NO: 1941 - RNA, 305 nt, artificial sequence
  synthetic construct
gcuguccuuaauuuucucugcgggagccgccaccgaacaaccggagcucguucccaaaacgguuuucacgguuccugccguauugguguugucguucauuuucccuuccucagacuucucguuuuggcucugauuaccauaauacugucgguuggguguuuuguuggauguauuccuaugcuuuugauucgcugaauucugcuguacuuggaaauuuacgggucucugaauaggcguuggauaccuuugcauauuagauccgccuacuccuugauacaaauuguacuucugcugcgccguggggc

SEQ ID NO: 1942 - RNA, 305 nt, artificial sequence
  synthetic construct
guaucaacaaaucgucaacaaucguuuuuggaucagucggagaagguccccuaacuuuuuuaaaaugcguggcuguuugcacuuuacguacaggcugcaugagagcaucucgaacaacuauacuuauaucugcacccgaauacccuucugucuugcuggcuaauucuuuaauguccucuucggucaauuccguucugguauuacccaaaugcaguuuaaacauuacagcccuggccggcuccuccggcagcgguauguaaauucucuuuucgaaacgucuucgaaucgcagaaucuaauacccac

SEQ ID NO: 1943 - RNA, 311 nt, artificial sequence
  synthetic construct
guuuauucuggaguuucuuuuuauccggaucuucaucuucaucgucgcugucgcucuucuuguccuccuuugauccuccaucuaaaacaggcuucuuuuucccuuuccgcagcgaaucuuuaauuuuuucggcccuuucuaaauacuguacgcacuuagcucuuaugcugucuuuggcuuugucgccuugagcuucauacuuuauggcaugcaaaaaguauucuacaccgugcucguacaaacgcagagccuccucguaguuuuuauuucgguccucuuccguagcuuucguuacuaauucuauggcuuuc

SEQ ID NO: 1944 - RNA, 308 nt, artificial sequence
  synthetic construct
gaucuuaacauaucauucagaguaacgggcggcucggcuaacuuaucacucgguauauccauccaggacauuucuauagcaccaggaucaccuggcgaacacgguaucaacaaaucgucaacaaucguuuuuggaucagucggagaagguccccuaacuuuuuuaaaaugcguggcuguuugcacuuuacguacaggcugcaugagagcaucucgaacaacuauacuuauaucugcacccgaauacccuucugucuugcuggcuaauucuuuaauguccucuucggucaauuccguucugguauuacc

SEQ ID NO: 1945 - RNA, 298 nt, artificial sequence
  synthetic construct
gaaaccguuaccguccuuaucgaauacucggaaugcuucgcgaauuucuuccucacugucugugucuuucauuuuacgcgccaucaucguuaagaauucaggaaagucgauuguuccauuaccaucggcaucuacuucauugaucauauccuguaauucagcuucuguaggauuuuguccuagagaucucauuacuguaccuaauucuuucguaguaaucguaccaucgccgucuuuaucgaacaacgagaaagcuucuuugaauucggcaauuuguucuucggugaguuggucagcc

SEQ ID NO: 1946 - RNA, 320 nt, artificial sequence
  synthetic construct
gccucccuaaucauuucaucgacuucuucguccgucaauuucucaccaagguuggucaucacguggcgcagcuccgccgccgaaaugaaaccguuaccguccuuaucgaauacucggaaugcuucgcgaauuucuuccucacugucugugucuuucauuuuacgcgccaucaucguuaagaauucaggaaagucgauuguuccauuaccaucggcaucuacuucauugaucauauccuguaauucagcuucuguaggauuuuguccuagagaucucauuacuguaccuaauucuuucguaguaaucguaccaucgccguc

SEQ ID NO: 1947 - RNA, 306 nt, artificial sequence
  synthetic construct
guaaaccgcgacaguaguucagguacauggaaaacucagcgggaaauccuuugcagaguacuucuaccggaguugacauuuucuucucacugauuuucucauauuuuuguuucuuaguagcagcuuuuaaaccuugccaggguaaacagccucuauugaaauacauuaaaacauauccuaaagauuccaugucaucucuacgugacugcucaaugccgaggugugcauuaauggaugcguaucgggcaguaccaguuaaauuuuuguccucucgauaaauaauaugcgcucuaguucuagcgucuc

SEQ ID NO: 1948 - RNA, 299 nt, artificial sequence
  synthetic construct
gagauggcccgaguagauccauaacgaggacauuaugcuccuuuucuuggccauaauaucugauaugugguauuccuaugccuccgugaagaaguuuauauaauuuacuuucauacaaaagcugaggaugucuugcucuaauugauucaaguuugacugcuacuuccucuccguuugugauauuuauucccaaauauaugucaccaaaagauccacuaccgauuuuacgaacuagacgauauuuuccaccgacuauauauuccgguuucccgauaccaagcccaaugccaugugaagcc

SEQ ID NO: 1949 - RNA, 302 nt, artificial sequence
  synthetic construct
guuuugccaaucccgcuuucguaagccacuggcaaauguuuucucguugaucgccuugcaauugaaggacuucaccguauucgggauguucuauaacuguuccguuacaugcaaacuccuuuuuacaugcucgaacaauuuucuuuaggucauauucuuucgagagcccuugaacaguagucagaguuuuacgaccauuacguugcuguauucuuauaugaacgaguccgucuuguacaucaucgucugcacccuuacuugcaucagcaaaggggucgaauguguuuagauucuggauggac

SEQ ID NO: 1950 - RNA, 393 nt, artificial sequence
  synthetic construct
guugccaagccuaauauuucgaacugcugcacgccgccgucgcgacccauucucgcgaucaauuucucuuccaaucucaaaugaacgucaucgauauccguuuugauagcgggggcuuuaguuccgggcugcgagauacuauucuuauuuggggcauugacguuuucaccuucggauuucaguugaucgacgaaggauuccacgucucuaguuuuuccuccuaauuucauaccacgcgguuuuuggguagcagacgguguguaagaaggagguuugacaucguuugucggaauagcaauauccccaauggauggugucggaguguaagucguagagcuaccgaagccuccgcuguugcuaaacauagccuugccgccuuucuuuugugccucc

SEQ ID NO: 1951 - RNA, 393 nt, artificial sequence
  synthetic construct
gucgccaugccuaauauuucgaauuguugcacuccuccaucacgacccauucuggcgaucaguuucucuuccaaucucaaguggacgucaucaauaucaguuuuaauagcaggugcuuuaguuccugguugcgagaugcuguuuuuauuuggaguuaugacguuuucuccuucagauuucaauugauccacaaaagauuccacaucucuacccuuuccgccuaguuucauaccacgagguuuuugugcagggguggcuguauaugaaggcggcuuaacaucguugaccugguuagcgauaucuccaauagauggcgucggaguauaaccgguggaacuaccaaaaccaccgcuguugcugaacgcagguuugccacccuucuuuugugcuucc

SEQ ID NO: 1952 - RNA, 432 nt, artificial sequence
  synthetic construct
gaagaaaucauugggaauggcucucggugcauugaauucuaacgacccagucuuguuacuagcgucaauaagcggcaaauuccaaaccagaugauuucuuuuagcuucauguguguauguaccaucacauucgccuacuaugggcgagcaaccgauuggcaauggaauuguaauauugacaucgaccaauuccaaauugaugugggcaaguucguauucgauguugacgucacaacugccgucgccagcuucugagggccaacaguugauuaauagaggcacuaaggcuucaucugugcucugcaaucgccauuuuagcacaccaacgucaguguggauggggaaaggcuuugagggcugcuucagaccaaucugcgaucguaacuugaauagcuccuuaucgacauuuggauggguuuggaguugaacacc

SEQ ID NO: 1953 - RNA, 400 nt, artificial sequence
  synthetic construct
ggaucgcaaucuuuaacgauaaacuucaacaccgccccgaacguaccgacgcaacucggcaaaucgucgucggggaacuucaauauagcguaggugugaucggucucguuguagugcagcugcuugcacggcaccaccgacagcaacucgaaccccucgcucggcuccagcuccacgcgcacguccuccagcaauugaucggccagcguguucaggcagucgaacugcaggaccacguggcgggcgaagcagugcuugaugcagcgcacgaaguacuccgucucggauucggucagcuccaccaccucggagcucuugaagaucgggcccagcugcuggaugcccgguauggcggacaguuucuccgcgaaguucuccucgcgggagacgggcggcggcc

SEQ ID NO: 1954 - RNA, 400 nt, artificial sequence
  synthetic construct
ggaucacaauccuugacaacaaauuuaagaacagcuccaaagguucccacacaacuuguuagaucaucaucagggaauuucaguaucacauaugucguccccguuugguuguaaugcaacuguucgcaggguauuucagccaaaauuucaaaguuuucauuaggguccaaaucgacccuaacauuuuccaagaguugaucagcaagaguguucaaacaaucgaauuguaaaacgauauggugagcaaaacaguguuugauacaacguacaaaauacucaguuucagauucaguaaguucaacgacuucugagcuucugaaaagagguccaaguuguuggaugccugggauggcagccaguuuuucggcgaaguucucuucucuggaaaccggcggcgggc

SEQ ID NO: 1955 - RNA, 404 nt, artificial sequence
  synthetic construct
ggcauuaauucagcgauuuuccuuaaauugauaccucuaguuagauucauuuuucucgaaugaauuuucaaaauguccaaucuggcuucuucguucgguggagggaacucaauuuuucugucaauucuuccaggucuaagcaaagcaggaucaagaaugucuauucuguugguagccaugaugacuuuaauguuuuugguugcuucaaaaccaucaagcugauuuaacaacuccaacaugguucuuuggacuucagaaucaccaccagagccagauucaauacgagaagauccuauagaaucaauuucguccaugaaaaugauggaaggugcaugcucucuggccauaacgaagagcucccugaccauucuggagcccucuccaaugaauuuuugaaccaauuc

SEQ ID NO: 1956 - RNA, 406 nt, artificial sequence
  synthetic construct
gaacccuucucucccucaaagcguacauacccgccucugugcaaacacccuuaacuucagccccgcuagcaccuggcauuaauucagcgauuuuccuuaaauugauaccucuaguuagauucauuuuucucgaaugaauuuucaaaauguccaaucuggcuucuucguucgguggagggaacucaauuuuucugucaauucuuccaggucuaagcaaagcaggaucaagaaugucuauucuguugguagccaugaugacuuuaauguuuuugguugcuucaaaaccaucaagcugauuuaacaacuccaacaugguucuuuggacuucagaaucaccaccagagccagauucaauacgagaagauccuauagaaucaauuucguccaugaaaaugauggaaggugc

SEQ ID NO: 1957 - RNA, 399 nt, artificial sequence
  synthetic construct
gaagcccacagguugacuaauagcaguuguaaucucauuggcaauaucguguuguucagcuaugucguccaugauaucguggacaucaucgacguucaaguuuuugugggccuucuggagggccucagcggcguuccucauggagucuaagacggcuguguuggugcuggcuccuuccaaggccucucuuugcauuucgaucgucguaagaguuccaucuauuuguaguugcguuuuuuccaaucguuucuucuuuuugagcgcuugaagcgccacucuuuuguucuucgaugcauucuuuuuggcuacuaaaguguauuccucuauuuucuuuucuaaaaacucuuguuuuuuauauaacauguccucgguuucccugagcuuuuggauggccucccc

SEQ ID NO: 1958 - RNA, 399 nt, artificial sequence
  synthetic construct
gaaaccaacuggauuacuaauagcguuugugaucucauuggcaaugucguguuguuccgcuauaucauccauuauaucaugaacauuaucaacauccagguucuugugugcuuuuuuaagggcaucagcagcauuuuucauagaaucuaaaaccgcuguguuaguacuagcuccuucgagggcuucccuuugcauuucaauaguuguaaguguuccaucgauuugcaguugagucuuuuccaaucuuuucuucuucuuaagagcuugaagggccacucguuuauucuuagaggcauuuuucuuagcuaauaauguguauucuucuauuuucuuuucuaaaaauuccuguuuuuuguauaacauuucuucaguuucucuaagcuucuggauagcuucgcc

SEQ ID NO: 1959 - RNA, 400 nt, artificial sequence
  synthetic construct
gcacgauaccgagaguagcagaagugacgggaucagagaaaucaccaccaggcggcgacacugcuccuacgaucgaaacagagccuucccuaucgggguuacccaagcacuuaacgcgaccggcgcgcucguagaacgaggccaaucgggcccccaaguaggccggguaaccggaaucggcgggcaucucggccaaacgaccggaaauuucucucaaagccucggcccaacgagaggucgaaucggccaucauggacacguuguaacccauaucacggaaguacucggacaacgugauaccgguguagauggaggccucacgggccgccacgggcauguuggagguguuggccaccaaggcgguacguuucaugauggauucggugugaccgucgauuuc

SEQ ID NO: 1960 - RNA, 400 nt, artificial sequence
  synthetic construct
guacgauaccaagaguagcagaugugacgggaucugaaaagucaccaccagggggagacacagcgccgacgauggacacggaacccucccugucgggauuacccaaacacuuaacgcgaccagcacguucguagaaagaggccaaacgggcucccaaauaggccggauaaccggaaucggcgggcaucucggccaaacgaccugaaauuucucucaaggcuucggcccaacgggagguggaaucggccaucauggauacauuguaacccauaucacggaaguacucugauagcgugauacccguauagauggaggccucacgggcggcuacgggcauguuugaaguguuggcuacuaaggcgguacguuucaugauagauucggucgcgccgucgauuuc

SEQ ID NO: 1961 - RNA, 305 nt, artificial sequence
  synthetic construct
guaucucggcaugggaaaucucgucugcaauauuuccugagcaucguccacgggugcuuguaacaguugucuaaaguuuucguauuccggcauaucuugguauuucaaguuacgccacugagcuauugucucuccguggaauaucaauauuuggaagaaaguguccaucaauaauauccucuccgauugaaucgaacucguauccaacagaacggguuccgggggcccguugaagcuguaacuguacaaaaucggcuggaucauaaucaaagacugcgucagaucuucucucauuaacaugugcc

SEQ ID NO: 1962 - RNA, 306 nt, artificial sequence
  synthetic construct
gaauaaauaucaacacaaugcccauuaguugcugcucucauagccaaagcaucauaaugcuuuauaccuuuuuucauauacuuugcauuaucuuuuugaauaucaugaugagaucuaauagguuguuuuaaaucaucauucaaaaccugaccaggcccuugagagcacgguccuccaacaaaaagcauaacucuagcuccuguauugggauaagugcucuccaacaaaccaauagcuauagauaaagcaacaccgguacaucuaagagaucucuuucccugaugaacaggccagggaucuuuuugc

SEQ ID NO: 1963 - RNA, 302 nt, artificial sequence
  synthetic construct
guaaucaaaccaauuaaagcauucggaggcaauaaacugagugacauuuguaaagaaucuuuaagugaacccaauucuuccucauccaugcaaguaucaacaacauacaagaauaucggugguaaacacugagcucuaguaauaguauacucaauaguugaaaacauaggcauuaacucagcagguugaugcuguucagaaauagcugcauauugagguggaaacggauugcguugaaaacaaaaauugcaaacccacaauuuugcucgauaaucaacuuggcacauaggauuuaaaaucgc

SEQ ID NO: 1964 - RNA, 311 nt, artificial sequence
  synthetic construct
guccauaagcaguauucuaucgggcuguauggaacucguaucuaauagaacaggcuccggagggccguugaaacuguaacuguacaaaauugguugaaucaugaucaaugauugaguaagaucuucucucaucagcauaugucgauagaacgacguuucaucaggagaauuauugaaaacuugcaggaacugagaccuccuuagaugguacaugaauugcggauagaggcuaaaguuuuggcccaaucugaaugaaccagcaucgucuuuauuguauucuccgaauuuuugacacaaucgaaucagcauuc

SEQ ID NO: 1965 - RNA, 302 nt, artificial sequence
  synthetic construct
guuuguaauaucucuugagcaucguccacgggcgcuugcaaaaguugccuaaaguuuucguauucgggcauauccugguacuucaaauuucgccauugcgcuauagucucuccguggaauaucaaaauuuggaaaaacguguccauaagcaguauucuaucgggcuguauggaacucguaucuaauagaacaggcuccggagggccguugaaacuguaacuguacaaaauugguugaaucaugaucaaugauugaguaagaucuucucucaucagcauaugucgauagaacgacguuucauc

SEQ ID NO: 1966 - RNA, 311 nt, artificial sequence
  synthetic construct
gaaaacuugcaggaacugagaccuccuuagaugguacaugaauugcggauagaggcuaaaguuuuggcccaaucugaaugaaccagcaucgucuuuauuguauucuccgaauuuuugacacaaucgaaucagcauucuaucgacccaucucagaacgucgggacuuucaucugauucagcucuauaaacagccauucuggccauaauuacagcugcugcuucuugaucaaaaccagcgcugaugugguggauauuaguaguggcgucagcccaguuucgagccacuguugucacucuaauucuucuuugac

SEQ ID NO: 1967 - RNA, 349 nt, artificial sequence
  synthetic construct
gacaguuuuaaucguaaaacgacgggaacaaaaguugaagagaucuuccagagauggcccgaguagauccauaacgaggacauuaugcuccuuuucuuggccauaauaucugauaugugguauuccuaugccuccgugaagaaguuuauauaauuuacuuucauacaaaagcugaggaugucuugcucuaauugauucaaguuugacugcuacuuccucuccguuugugauauuuauucccaaauauaugucaccaaaagauccacuaccgauuuuacgaacuagacgauauuuuccaccgacuauauauuccgguuucccgauaccaagcccaaugccaugugaagcc

SEQ ID NO: 1968 - RNA, 369 nt, artificial sequence
  synthetic construct
gauaaauaauaugcgcucuaguucuagcgucucuaaauuuuuucgccaguccgaaaucgauuaagaauaguuuguugcagugacggccgaugcccaucaggaaguuaucgggcuuuaugucacgauggaugaaugauuugcaguggacaaauucuaugcgaccaaucauuugaucggcuaacaugaggacaguuuuaaucguaaaacgacgggaacaaaaguugaagagaucuuccagagauggcccgaguagauccauaacgaggacauuaugcuccuuuucuuggccauaauaucugauaugugguauuccuaugccuccgugaagaaguuuauauaauuuacuuucauacaaaagcugaggauguc

SEQ ID NO: 1969 - RNA, 351 nt, artificial sequence
  synthetic construct
gucaauuucucaccaagguuggucaucacguggcgcagcuccgccgccgaaaugaaaccguuaccguccuuaucgaauacucggaaugcuucgcgaauuucuuccucacugucugugucuuucauuuuacgcgccaucaucguuaagaauucaggaaagucgauuguuccauuaccaucggcaucuacuucauugaucauauccuguaauucagcuucuguaggauuuuguccuagagaucucauuacuguaccuaauucuuucguaguaaucguaccaucgccgucuuuaucgaacaacgagaaagcuucuuugaauucggcaauuuguucuucggugaguuggucagcc

SEQ ID NO: 1970 - RNA, 365 nt, artificial sequence
  synthetic construct
gccucccuaaucauuucaucgacuucuucguccgucaauuucucaccaagguuggucaucacguggcgcagcuccgccgccgaaaugaaaccguuaccguccuuaucgaauacucggaaugcuucgcgaauuucuuccucacugucugugucuuucauuuuacgcgccaucaucguuaagaauucaggaaagucgauuguuccauuaccaucggcaucuacuucauugaucauauccuguaauucagcuucuguaggauuuuguccuagagaucucauuacuguaccuaauucuuucguaguaaucguaccaucgccgucuuuaucgaacaacgagaaagcuucuuugaauucggcaauuuguuc

SEQ ID NO: 1971 - RNA, 329 nt, artificial sequence
  synthetic construct
agaaaccauggaccuuuaguuggucggguuuugccaaucccgcuuucguaagccacuggcaaauguuuucucguugaucgccuugcaauugaaggacuucaccguauucgggauguucuauaacuguuccguuacaugcaaacuccuuuuuacaugcucgaacaauuuucuuuaggucauauucuuucgagagcccuugaacaguagucagaguuuuacgaccauuacguugcuguauucuuauaugaacgaguccgucuuguacaucaucgucugcacccuuacuugcaucagcaaaggggucgaauguguuuagauucuggauggac

SEQ ID NO: 1972 - RNA, 352 nt, artificial sequence; identical to SEQ ID NO: 1187
  synthetic construct

SEQ ID NO: 1973 - RNA, 349 nt, artificial sequence
  synthetic construct
gagaugauuucuuuuugcuucgugaguguaugagccaucgcauucacccacuauuggagagcaaccaauuggcaaagggauuguaauauuaacguccacuaauucuaaguuagugugggcaaguucguauucaauauucacaucgcaacugccgucucccgcuucagaaggccaacaguuuauuaguagaggcacuagggcuucgucaguacucugcaaucgccauuuuaacacaccaacgucggugugcagcgggaaugguuucgaaggcuguuucaaaccaauuucugaacguaauuugaacaguuccuuaucgacauucgggugcguuugaagcugaacuccgugc

SEQ ID NO: 1974 - RNA, 230 nt, artificial sequence; identical to SEQ ID NO: 1164
  synthetic construct

SEQ ID NO: 1975 - RNA, 194 nt, artificial sequence
  synthetic construct
gcaacagccauuucgaaauccucuuguguuacaugcacccuucucucccuuagggcguacauaccagccucaguacacacucccuucacuucugcaccgcuagcgcccggcaucaauuccgcgauuuuccucaaauugaucccucuggucaaauucauuuuccucgagugaauuuucaggauguccaaucgggc

What is claimed is:

1. A method of causing mortality or stunting in an insect, comprising contacting said insect with at least one insecticidal polynucleotide comprising at least one silencing element comprising an RNA strand identical or complementary to 21 or more contiguous nucleotides of an insect target gene sequence that has a DNA sequence of SEQ ID NO: 310, and the complement thereof, wherein said insect is *Phyllotreta* spp., and wherein ingestion of said recombinant RNA by said insect results in mortality or stunting in said insect.

2. The method of claim 1, wherein said silencing element comprises an RNA strand having a sequence identical or complementary to 21 or more contiguous nucleotides of SEQ ID NO: 1169.

3. The method of claim 1, wherein said insecticidal polynucleotide is provided in a microbial or plant cell that expresses said insecticidal polynucleotide, or in a microbial fermentation product, or is chemically synthesized.

4. The method of claim 1, wherein said at least one insecticidal polynucleotide is provided in a composition comprising said at least one insecticidal polynucleotide, and wherein said composition:
   (a) is applied to a surface of said insect or to a surface of a seed or plant in need of protection from infestation by said insect;
   (b) comprises a solid, liquid, powder, suspension, emulsion, spray, encapsulation, microbeads, carrier particulates, film, matrix, soil drench, or seed treatment;
   (c) further comprises one or more components selected from the group consisting of a carrier agent, a surfactant, an organosilicone, a polynucleotide herbicidal molecule, a non-polynucleotide herbicidal molecule, a non-polynucleotide pesticide, a fungicide, a safener, a fertilizer, a micronutrient, an insect attractant, and an insect growth regulator;
   (d) further comprises at least one pesticidal agent selected from the group consisting of a patatin, a plant lectin, a phytoecdysteroid, a *Bacillus thuringiensis* insecticidal protein, a *Xenorhabdus* insecticidal protein, a *Photorhabdus* insecticidal protein, a *Bacillus laterosporous* insecticidal protein, a *Bacillus sphaericus* insecticidal protein, a bacterium that produces an insecticidal protein, an entomicidal bacterial species, *Lysinibacillus sphaericus* (*Bacillus sphaericus*), *Brevibacillus laterosporus* (*Bacillus laterosporus*), *Chromobacterium* species, *Chromobacterium subtsugae*, *Paenibacillus* species, *Paenibacillus lentimorbus*, and *Paenibacillus popilliae*; or
   (e) is ingested by said insect.

5. The method of claim 1, wherein said at least one insecticidal polynucleotide is a double-stranded RNA (dsRNA).

6. The method of claim 5, wherein said contacting comprises:
   (a) oral delivery to said insect, non-oral delivery to said insect, or a combination of oral and non-oral delivery to said insect;
   (b) application of a composition comprising said dsRNA to a surface of said insect or to a surface of said plant infested by said insect;
   (c) providing said dsRNA in a composition that further comprises one or more components selected from the group consisting of a carrier agent, a surfactant, an organosilicone, a polynucleotide herbicidal molecule, a non-polynucleotide herbicidal molecule, a non-polynucleotide pesticide, a fungicide, a safener, a fertilizer, a micronutrient, an insect attractant, and an insect growth regulator;
   (d) providing said dsRNA in a composition that further comprises at least one pesticidal agent selected from the group consisting of a patatin, a plant lectin, a phytoecdysteroid, a *Bacillus thuringiensis* insecticidal protein, a *Xenorhabdus* insecticidal protein, a *Photorhabdus* insecticidal protein, a *Bacillus laterosporous* insecticidal protein, a *Bacillus sphaericus* insecticidal protein, a bacterium that produces an insecticidal protein, an entomicidal bacterial species, *Lysinibacillus sphaericus* (*Bacillus sphaericus*), *Brevibacillus laterosporus* (*Bacillus laterosporus*), *Chromobacterium* species, *Chromobacterium subtsugae*, *Paenibacillus* species, *Paenibacillus lentimorbus*, and *Paenibacillus popilliae*; or
   (e) providing said dsRNA in a composition that is ingested by said insect.

7. The method of claim 5, wherein said dsRNA comprises an RNA strand having a sequence identical or complementary to 21 or more contiguous nucleotides of SEQ ID NO: 1169.

8. The method of claim 1, wherein said insect is a species selected from the group consisting of *Phyllotreta armoraciae* (horseradish flea beetle), *Phyllotreta cruciferae* (canola flea beetle), *Phyllotreta pusilla* (western black flea beetle), *Phyllotreta nemorum* (striped turnip flea beetle), *Phyllotreta atra* (turnip flea beetle), *Phyllotreta robusta* (garden flea beetle), *Phyllotreta striolata* (striped flea beetle), *Phyllotreta undulata*, *Psylliodes chrysocephala*, and *Psylliodes punctulata* (hop flea beetle).

9. A method of providing a plant having improved resistance to an insect, comprising expressing in said plant a recombinant DNA construct comprising a heterologous promoter operably linked to DNA encoding a dsRNA transcript comprising a sequence identical or complementary to 24 or more contiguous nucleotides of an insect target gene sequence that has a DNA sequence of SEQ ID NO: 310 and the complement thereof, wherein said insect is *Phyllotreta* spp., and wherein ingestion of said dsRNA by said insect results in mortality or stunting in said insect.

10. The method of claim 9, wherein:
   (a) said plant is selected from an ornamental plant or a crop plant;
   (b) said plant is a plant in the family Brassicaceae;
   (c) said plant is a *Brassica* species selected from the group consisting of *B. napus*, *B. juncea*, *B. carinata*, *B. rapa*, *B. oleracea*, *B. rupestris*, *B. septiceps*, *B. nigra*, *B. narinosa*, *B. perviridus*, *B. tournefortii*, and *B. fructiculosa*;
   (d) said plant is a *Brassica* plant selected from the group consisting canola, rapeseed, turnips, and field mustard or turnip rape; or
   (e) said plant is selected from the group consisting of *Glycine max, Linum usitatissimum, Zea mays, Carthamus tinctorius, Helianthus annuus, Nicotiana tabacum, Arabidopsis thaliana, Betholettia excelsa, Ricinus communis, Cocos nucifera, Coriandrum sativum, Gossypium* spp., *Arachis hypogaea, Simmondsia chinensis, Solanum tuberosum, Elaeis guineensis, Olea europaea, Oryza sativa, Cucurbita maxim, Hordeum vulgare*, and *Triticum aestivum*.

11. The method of claim 9, wherein:
(a) said method further comprises expression in said plant of at least one pesticidal agent selected from the group consisting of a patatin, a plant lectin, a phytoecdysteroid, a *Bacillus thuringiensis* insecticidal protein, a *Xenorhabdus* insecticidal protein, a *Photorhabdus* insecticidal protein, a *Bacillus laterosporous* insecticidal protein, a *Bacillus sphaericus* insecticidal protein, a bacterium that produces an insecticidal protein, an entomicidal bacterial species, *Lysinibacillus sphaericus* (*Bacillus sphaericus*), *Brevibacillus laterosporus* (*Bacillus laterosporus*), *Chromobacterium* species, *Chromobacterium subtsugae, Paenibacillus* species, *Paenibacillus lentimorbus*, and *Paenibacillus popilliae*; or
(b) said method further comprises expression in said plant of at least one protein conferring tolerance to an herbicide.

* * * * *